(12) United States Patent
Abudayyeh et al.

(10) Patent No.: US 12,404,514 B2
(45) Date of Patent: Sep. 2, 2025

(54) CRISPR-SYSTEMS FOR MODIFYING A TRAIT OF INTEREST IN A PLANT

(71) Applicants: THE BROAD INSTITUTE, INC., Cambridge, MA (US); MASSACHUSETTS INSTITUTE OF TECHNOLOGY, Cambridge, MA (US); REGENTS OF THE UNIVERSITY OF MINNESOTA, Minneapolis, MN (US); PRESIDENT AND FELLOWS OF HARVARD COLLEGE, Cambridge, MA (US)

(72) Inventors: Omar Abudayyeh, Cambridge, MA (US); Joseph John Belanto, Minneapolis, MN (US); Jonathan Gootenberg, Cambridge, MA (US); Colby Garret Starker, Minneapolis, MN (US); Daniel Francis Voytas, Minneapolis, MN (US); Feng Zhang, Cambridge, MA (US)

(73) Assignees: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

( * ) Notice: Subject to any disclaimer, the term of this patent is extended or adjusted under 35 U.S.C. 154(b) by 0 days.

(21) Appl. No.: 16/468,234

(22) PCT Filed: Dec. 8, 2017

(86) PCT No.: PCT/US2017/065438
§ 371 (c)(1),
(2) Date: Jun. 10, 2019

(87) PCT Pub. No.: WO2018/107103
PCT Pub. Date: Jun. 14, 2018

(65) Prior Publication Data
US 2019/0352652 A1 Nov. 21, 2019

Related U.S. Application Data

(60) Provisional application No. 62/432,543, filed on Dec. 9, 2016, provisional application No. 62/567,959, filed on Oct. 4, 2017.

(51) Int. Cl.
C12N 15/82 (2006.01)
C12N 9/22 (2006.01)

(52) U.S. Cl.
CPC .......... *C12N 15/8213* (2013.01); *C12N 9/22* (2013.01); *C12N 15/8283* (2013.01); *C12N 2310/20* (2017.05)

(58) Field of Classification Search
CPC .............................. C12N 9/22; C12N 15/8283
See application file for complete search history.

(56) References Cited

U.S. PATENT DOCUMENTS

| | | | |
|---|---|---|---|
| 4,186,183 A | 1/1980 | Steck et al. |
| 4,217,344 A | 8/1980 | Vanlerberghe et al. |
| 4,235,871 A | 11/1980 | Papahadjopoulos et al. |
| 4,261,975 A | 4/1981 | Fullerton et al. |
| 4,485,054 A | 11/1984 | Mezei et al. |
| 4,501,728 A | 2/1985 | Geho et al. |
| 4,774,085 A | 9/1988 | Fidler |
| 4,837,028 A | 6/1989 | Allen |
| 4,897,355 A | 1/1990 | Eppstein et al. |
| 4,946,787 A | 8/1990 | Eppstein et al. |
| 5,049,386 A | 9/1991 | Eppstein et al. |
| 5,210,015 A | 5/1993 | Gelfand et al. |
| 5,445,934 A | 8/1995 | Fodor et al. |
| 5,543,158 A | 8/1996 | Gref et al. |
| 5,563,055 A | 10/1996 | Townsend et al. |
| 5,855,913 A | 1/1999 | Hanes et al. |
| 5,985,309 A | 11/1999 | Edwards et al. |
| 6,007,845 A | 12/1999 | Domb et al. |
| 6,603,061 B1 | 8/2003 | Armstrong et al. |
| 7,776,321 B2 | 8/2010 | Cascalho et al. |
| 7,868,149 B2 | 1/2011 | Boukharov et al. |

(Continued)

FOREIGN PATENT DOCUMENTS

| | | | |
|---|---|---|---|
| EP | 2 764 103 B1 | 8/2014 |
| EP | 2 771 468 B1 | 9/2014 |

(Continued)

OTHER PUBLICATIONS

Xie et al (RNA-Guided Genome Editing in Plants Using a CRISPR-Cas System. Molecular Plant 6:1975-1983, 2013) (Year: 2013).*
Yamano et al (Crystal Structure of Cpf1 in Complex with Guide RNA and Target DNA. Cell. 165: 949-962, May 2016). (Year: 2016).*
Zetsche et al (Cpf1 is a single RNA-guided endonuclease of a Class 2 CRISPR-Cas system. Cell. 163(3): 759-771, published Oct. 2015). (Year: 2015).*
Endo et al (Efficient targeted mutagenesis of rice and tobacco genomes using Cpf1 from Francisella novicida. Nature Scientific Report. Published Dec. 1, 2016). (Year: 2016).*

(Continued)

*Primary Examiner* — Shubo (Joe) Zhou
*Assistant Examiner* — Wayne Zhong
(74) *Attorney, Agent, or Firm* — F. Brent Nix, Esq.; Johnson, Marcou, Isaacs & Nix, LLC; Ming Zhang

(57) ABSTRACT

The present invention generally relates to plants comprising a CRISPR system or parts of a CRISPR system, compositions, containers, polynucleotide, vectors, delivery systems, parts of plants, methods for production, CRISPR systems, and components thereof. Further aspects of the invention include a method for identifying a CRISPR system which is functional in a plant cell and a method for improving a CRISPR system in a plant.

19 Claims, 8 Drawing Sheets

Specification includes a Sequence Listing.

(56) References Cited

U.S. PATENT DOCUMENTS

| | | |
|---|---|---|
| 8,044,019 B2 | 10/2011 | Uno et al. |
| 8,372,951 B2 | 2/2013 | Chang et al. |
| 8,575,305 B2 | 11/2013 | Gait et al. |
| 8,614,194 B1 | 12/2013 | Chen et al. |
| 8,697,359 B1 | 4/2014 | Zhang |
| 8,709,843 B2 | 4/2014 | Shakuda |
| 8,771,945 B1 | 7/2014 | Zhang |
| 8,795,965 B2 | 8/2014 | Zhang |
| 8,865,406 B2 | 10/2014 | Zhang et al. |
| 8,871,445 B2 | 10/2014 | Cong et al. |
| 8,889,356 B2 | 11/2014 | Zhang |
| 8,889,418 B2 | 11/2014 | Zhang et al. |
| 8,895,308 B1 | 11/2014 | Zhang et al. |
| 8,906,616 B2 | 12/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 8,999,641 B2 | 4/2015 | Zhang et al. |
| 2004/0142476 A1 | 7/2004 | Evans et al. |
| 2004/0171156 A1 | 9/2004 | Hartley et al. |
| 2009/0100536 A1 | 4/2009 | Adams et al. |
| 2011/0027239 A1 | 2/2011 | Paek et al. |
| 2011/0265198 A1 | 10/2011 | Gregory et al. |
| 2012/0017290 A1 | 1/2012 | Cui et al. |
| 2013/0185823 A1 | 7/2013 | Kuang et al. |
| 2013/0236946 A1 | 9/2013 | Gouble |
| 2014/0170753 A1 | 6/2014 | Zhang |
| 2014/0179006 A1 | 6/2014 | Zhang |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |
| 2014/0227787 A1 | 8/2014 | Zhang |
| 2014/0234972 A1 | 8/2014 | Zhang |
| 2014/0242664 A1 | 8/2014 | Zhang et al. |
| 2014/0242699 A1 | 8/2014 | Zhang |
| 2014/0242700 A1 | 8/2014 | Zhang et al. |
| 2014/0248702 A1 | 9/2014 | Zhang et al. |
| 2014/0256046 A1 | 9/2014 | Zhang et al. |
| 2014/0273231 A1 | 9/2014 | Zhang et al. |
| 2014/0273232 A1 | 9/2014 | Zhang et al. |
| 2014/0273234 A1 | 9/2014 | Zhang et al. |
| 2014/0273235 A1 | 9/2014 | Voytas et al. |
| 2014/0287938 A1 | 9/2014 | Zhang et al. |
| 2014/0310830 A1 | 10/2014 | Zhang et al. |
| 2014/0335620 A1 | 11/2014 | Zhang et al. |
| 2015/0291966 A1 | 10/2015 | Zhang et al. |
| 2016/0208243 A1* | 7/2016 | Zhang .................... C12N 15/82 |
| 2017/0211142 A1 | 7/2017 | Smargon et al. |

FOREIGN PATENT DOCUMENTS

| | | | |
|---|---|---|---|
| EP | 2 784 162 A1 | 10/2014 | |
| WO | 9116024 A1 | 10/1991 | |
| WO | 9117424 A1 | 11/1991 | |
| WO | 2008042156 A1 | 4/2008 | |
| WO | 2011028929 A3 | 10/2011 | |
| WO | 2014018423 A2 | 1/2014 | |
| WO | 2014093595 A1 | 6/2014 | |
| WO | 2014093622 A2 | 6/2014 | |
| WO | 2014093635 A1 | 6/2014 | |
| WO | 2014093655 A2 | 6/2014 | |
| WO | 2014093661 A2 | 6/2014 | |
| WO | 2014093694 A1 | 6/2014 | |
| WO | 2014093701 A1 | 6/2014 | |
| WO | 2014093709 A1 | 6/2014 | |
| WO | 2014093712 A1 | 6/2014 | |
| WO | 2014093718 A1 | 6/2014 | |
| WO | 2014204723 A1 | 12/2014 | |
| WO | 2014204724 A1 | 12/2014 | |
| WO | 2014204725 A1 | 12/2014 | |
| WO | 2014204726 A1 | 12/2014 | |
| WO | 2014204727 A1 | 12/2014 | |
| WO | 2014204728 A1 | 12/2014 | |
| WO | 2014204729 A1 | 12/2014 | |
| WO | 2015065964 A1 | 5/2015 | |
| WO | 2015089419 A2 | 6/2015 | |
| WO | 2015189693 A1 | 12/2015 | |
| WO | WO-2016205764 A1 * | 12/2016 | ........... C12N 15/102 |
| WO | 2017070605 A1 | 4/2017 | |
| WO | 2017219027 A1 | 12/2017 | |
| WO | 2018035250 A1 | 2/2018 | |
| WO | WO-2018107103 A1 * | 6/2018 | ............. C12N 15/11 |
| WO | 2019005866 A1 | 1/2019 | |

OTHER PUBLICATIONS

Li et al (Cas9-Guide RNA Directed Genome Editing in Soybean. Plant Physiology, 169, pp. 960-970, 2015) (Year: 2015).*

Abudayyeh et al (C2c2 is a single-component programmable RNA-guided RNA targeting CRISPR effector. Science. 535: 1-23, published Aug. 2016) (Year: 2016).*

East-Seletsky et al (Two distinct RNase activities of CRISPR-C2c2 enable guide-RNA processing and RNA detection. Nature. 538: 270-275, Oct. 2016). (Year: 2016).*

Sanfacon (Plant Translation Factors and Virus Resistance. Viruses, 7, 3392-3419, 2015) (Year: 2015).*

Collins et al (Self-Cleaving Circular RNA Associated with Rice Yellow Mottle Virus Is the Smallest Viroid-like RNA. Virology 241, 269-275, 1998) (Year: 1998).*

Abudayyeh (C2c2 is a single-component programmable RNA-guided RNA-targeting CRISPR effector. Science. 1-23, 2016) (Year: 2016).*

International Preliminary Report on Patentability issued in International Application No. PCT/US2017/065438, mailed on Jun. 20, 2019, 10 pages.

Abil, et al., "Engineering Reprogrammable RNA-Binding Proteins for Study and Manipulation of the Transcriptome", Molecular BioSystems, The Royal Society of Chemistry, vol. 11, No. 10, Jul. 6, 2015, 2658-2665.

Abudayyeh, et al., "C2c2 is a Single-Component Programmable RNA-Guided RNA-Targeting CRISPR Effector", Science, vol. 353, No. 6299, Aug. 5, 2016, 11 pages.

Belhaj, et al., "Plant Genome Editing Made Easy: Targeted Mutagenesis in Model and Crop Plants Using the CRISPR/Cas System", Plant Methods, vol. 9, No. 39, Oct. 11, 2013, 1859-1872.

Bocobza, et al., "Small Molecules that Interact with RNA: Riboswitch-Based Gene Control and its Involvement in Metabolic Regulation in Plants and Algae", The Plant Journal, vol. 79, No. 4, 2014, 693-703.

Brooks, et al., "Efficient Gene Editing in Tomato in the First Generation Using the Clustered Regularly Interspaced Short Palindromic Repeats/CRISPR-Associated9 System", Plant Physiology, vol. 166, No. 3, Nov. 2014, 1292-1297.

Caliando, et al., "Targeted DNA Degradation using a CRISPR Device Stably Carried in the Host Genome", Nature Communications, vol. 6, No. 6989, May 19, 2015, 10 pages.

Canver, et al., "BCL11A Enhancer Dissection by Cas9-Mediated In Situ Saturating Mutagenesis", Nature, vol. 527, Nov. 12, 2015, 192-197.

Cheah, et al., "Control of Alternative RNA Splicing and Gene Expression by Eukaryotic Riboswitches", Nature, vol. 447, No. 7143, May 24, 2007, 497-500.

Chen, et al., "A Highly Efficient Transient Protoplast System for Analyzing Defence Gene Expression and Protein-Protein Interactions in Rice", Molecular Plant Pathology, vol. 7, No. 5, Sep. 2006, 417-427.

Chen, et al., "Genome-Wide CRISPR Screen in a Mouse Model of Tumor Growth and Metastasis", Cell, vol. 160, No. 6, Mar. 12, 2015, 1246-1260.

Chen, et al., "Predicting Peptide-Mediated Interactions on a Genome-Wide Scale", PLOS Computational Biology, vol. 11, No. 5, May 4, 2015, 13 pages.

Chen, et al., "RNA Imaging. Spatially Resolved, Highly Multiplexed RNA Profiling in Single Cells", Science, vol. 348, No. 6233, Apr. 24, 2015, 14 pages.

Cong, et al., "Multiplex Genome Engineering Using CRISPR/Cas Systems", Science, vol. 339, No. 6121, Feb. 15, 2013, 819-823.

(56) References Cited

OTHER PUBLICATIONS

CRISPR-Plant, "A Portal of CRISPR-Cas9 Mediated Genome Editing", CRISPR-Plant is supported by Penn State and AGI, Oct. 15, 2010, 2 pages.
Curtin, et al., "A Genome Engineering Toolbox for Legume Functional Genomics", International Plant and Animal Genome Conference XXII 2014, 2014.
Dey, et al., "Toward a "Structural BLAST": Using Structural Relationships to Infer Function", Protein Science, vol. 22, No. 4, Apr. 2013, 359-366.
Doench, et al., "Rational Design of Highly Active SgRNAs for CRISPR-Cas9-Mediated Gene Inactivation", Nature Biotechnology, vol. 32, No. 12, Dec. 2014, 1262-1267.
Dudareva, et al., "Biosynthesis, Function and Metabolic Engineering of Plant Volatile Organic Compounds", New Phytologist, vol. 198, No. 1, Apr. 2013, 16-32.
Feng, et al., "Efficient Genome Editing in Plants using a CRISPR/Cas System", Cell Research, vol. 23, Aug. 20, 2013, 1229-1232.
Fu, et al., "Gene Expression Regulation Mediated Through Reversible M6A RNA Methylation", Nature Reviews Genetics, vol. 15, No. 5, May 2014, 293-306.
Gao, et al., "Engineered Cpf1 Enzymes with Altered PAM Specificities", BioRxiv, Dec. 4, 2016, 17 pages.
Gerbasch, et al., "Pulling the Strings of Our Genetic Puppetmasters: Engineers Gain Control of Gene Activity", Nature Biotechnology, Apr. 6, 2015.
Goldfless, et al., "Direct and Specific Chemical Control of Eukaryotic Translation with a Synthetic RNA-Protein Interaction", Nucleic Acids Research, vol. 40, No. 9, 2012, 1-12.
Green, "Current State of Herbicides in Herbicide-Resistant Crops", Society of Chemical Industry, Pest Management Science, vol. 70, No. 9, Jan. 20, 2014, 1351-1357.
Grennan, "To Thy Proteins Be True: RNA Editing in Plants", Plant Physiology, vol. 156, No. 2, Jun. 2011, 2 pages.
Guidi, et al., "Application of RNAi to Genomic Drug Target Validation in Schistosomes", PLOS Neglected Tropical Diseases, University of Cambridge, United Kingdom, vol. 9, No. 5, May 20, 2015, 22 pages.
Hebelstrup, et al., "The Future of Starch Bioengineering: GM Microorganisms or GM Plants?", Frontiers in Plant Science, vol. 6, Article 247, Apr. 23, 2015, 6 pages.
Hlavova, et al., "Improving Microalgae for Biotechnology—From Genetics to Synthetic Biology", Biotechnology Advances, vol. 33, Issue 6, Part 2, Nov. 2015, 1194-1203.
Hsu, et al., "Development and Applications of CRISPR-Cas9 for Genome Engineering", Cell, vol. 157, No. 6, Jun. 5, 2014, 1262-1278.
Hsu, et al., "DNA Targeting Specificity of RNA-Guided Cas9 Nucleases", Nature Biotechnology, vol. 31, No. 9, Sep. 2013, 827-832.
Jain, et al., "Validation of Housekeeping Genes as Internal Control for Studying Gene Expression in Rice by Quantitative Real-Time PCR", Biochemical and Biophysical Research Communications, vol. 345, No. 2, Jun. 30, 2006, 646-651.
Jiang, et al., "RNA-Guided Editing of Bacterial Genomes Using CRISPR-Cas Systems", Nature Biotechnology, vol. 31, No. 3, Mar. 2013, 233-239.
Joung, et al., "Genome-Scale Crispr-Cas9 Knockout and Transcriptional Activation Screening", Nature Protocols, vol. 12, No. 4, Apr. 2017, 828-863.
Kabadi, et al., "Multiplex CRISPR/Cas9-based Genome Engineering from a Single Lentiviral Vector", Nucleic Acids Research, vol. 42, No. 19, Aug. 13, 2014, 11 pages.
Kawai, et al., "Transformation of *Saccharomyces cerevisiae* and Other Fungi: Methods and Possible Underlying Mechanism", Bioengineered Bugs, vol. 1, No. 6, Nov.-Dec. 2010, 395-403.
Kim, et al., "RNA Interference: Applications and Advances in Insect Toxicology and Insect Pest Management", Pesticide Biochemistry and Physiology, vol. 120, 2015, 109-117.

Konermann, et al., "Genome-Scale Transcriptional Activation by an Engineered CRISPR-Cas9 Complex", Nature, vol. 517, No. 7536, Jan. 29, 2015, 583-588.
Konermann, et al., "Optical Control of Mammalian Endogenous Transcription and Epigenetic States", Nature, vol. 500, No. 7463, Aug. 22, 2013, 472-476.
Kurth, et al., "Virus-Derived Gene Expression and RNA Interference Vector for Grapevine", Journal of Virology, vol. 86, No. 11, Jun. 2012, 6002-6009.
Lowder, et al., "A CRISPR/Cas9 Toolbox for Multiplexed Plant Genome Editing and Transcriptional Regulation", Plant Physiology, vol. 169., Oct. 2015, 15 pages.
Ma, et al., "A Robust CRISPR/Cas9 System for Convenient, High-Efficiency Multiplex Genome Editing in Monocot and Dicot Plants", Molecular Plant, vol. 8, No. 8, Aug. 3, 2015, 1274-1284.
MacKay, et al., "The Prospects for Designer Single-Stranded RNA-Binding Proteins", Nature Structural & Molecular Biology, vol. 18, No. 3, Mar. 2011, 256-261.
Makkonen, et al., "Baculovirus-Mediated Gene Delivery and RNAi Applications", Viruses, vol. 7, No. 4, 2015, 2099-2125.
Miyamura, et al., "Mutations of the RNA-Specific Adenosine Deaminase Gene (DSRAD) are Involved in Dyschromatosis Symmetrica Hereditaria", American Journal of Human Genetics, vol. 73, 2003, 693-699.
Morrell, et al., "Crop Genomics: Advances and Applications", Nature Reviews Genetics, vol. 13, Feb. 2012, 85-96.
Murray, et al., "Suppressors of RNAi from Plant Viruses are Subject to Episodic Positive Selection", Proceedings of the Royal Society B, vol. 280, No. 1765, Jun. 2013, 1-9.
Nelles, et al., "Applications of Cas9 as an RNA-Programmed RNA-Binding Protein", Bioessays, vol. 37, 2015, 1-8.
Nishimasu, et al., "Crystal Structure of Cas9 in Complex with Guide RNA and Target DNA", Cell, vol. 156, No. 5, Feb. 27, 2014, 935-949.
Platt, et al., "CRISPR-Cas9 Knockin Mice for Genome Editing and Cancer Modelling", Cell, vol. 159, No. 2, Oct. 9, 2014, 440-455.
Zhou, et al., "RNase Z(S1) Processes UbL40 mRNAs and Controls Thermosensitive Genic Male Sterility in Rice", Nature Communications, vol. 5, No. 4884, Sep. 11, 2014, 9 pages.
Nishimasu, et al., "Crystal Structure of *Staphylococcus aureus* Cas9", Cell, vol. 162, No. 5, Aug. 27, 2015, 1113-1126.
Osakabe, et al., "Optimization of CRISPR/Cas9 Genome Editing to Modify Abiotic Stress Responses in Plants", Scientific Reports, vol. 6, No. 26685, May 26, 2016, 10 pages.
Parnas, et al., "A Genome-Wide CRISPR Screen in Primary Immune Cells to Dissect Regulatory Networks", Cell, vol. 162, No. 3, Jul. 30, 2015, 675-686.
Petersen, et al., "Towards precisely glyco engineered plants", Plant Biotech Denmark Annual Meeting, Jan. 28-29, 2015, 6 pages.
Price, et al., "Cas9-Mediated Targeting of Viral RNA in Eukaryotic Cells", Proceedings of the National Academy of Sciences, vol. 112, No. 19, May 12, 2015, 6164-6169.
Ramakrishna, et al., "Gene Disruption by Cell-Penetrating Peptide-Mediated Delivery of Cas9 Protein and Guide RNA", Genome Research, vol. 24, No. 6, Jun. 2014, 1020-1027.
Ramanan, et al., "CRISPR/Cas9 Cleavage of Viral DNA Efficiently Suppresses Hepatitis B Virus", Scientific Reports, vol. 5, No. 10833, Jun. 2, 2015, 9 pages.
Ran, et al., "Double Nicking by RNA-Guided CRISPR Cas9 for Enhanced Genome Editing Specificity", Cell, vol. 154, No. 6, Sep. 12, 2013, 1380-1389.
Ran, et al., "Genome Engineering Using the CRISPR-Cas9 System", Nature Protocols, vol. 8, No. 11, Nov. 2013, 2281-2308.
Ran, et al., "In Vivo Genome Editing using *Staphylococcus aureus* Cas9", Nature, vol. 520, No. 7546, Apr. 9, 2015, 186-191.
Sainsbury, et al., "pEAQ: Versatile Expression Vectors for Easy and Quick Transient Expression of Heterologous Proteins in Plants", Plant Biotechnology Journal, vol. 7, No. 7, 2009, 682-693.
Samai, et al., "Co-Transcriptional DNA and RNA Cleavage During Type III CRISPR-Cas Immunity", Cell, vol. 161, No. 5, May 21, 2015, 1164-1174.

(56) References Cited

OTHER PUBLICATIONS

Sapranauskas, et al., "The *Streptococcus thermophilus* CRISPR/Cas System Provides Immunity in *Escherichia coli*", Nucleic Acids Research, vol. 39, No. 21, Aug. 2011, 9275-9282.
Shalem, et al., "Genome-Scale CRISPR-Cas9 Knockout Screening in Human Cells", Science, vol. 343, No. 6166, Jan. 3, 2014, 84-87.
Shalem, et al., "High-Throughput Functional Genomics Using CRISPR-Cas9", Nature Reviews Genetics, vol. 16, No. 5, May 2015, 299-311.
Shan, et al., "Targeted Genome Modification of Crop Plants Using a CRISPR-Cas System", Nature biotechnology, vol. 31, No. 8, Aug. 2013, 686-688.
Sharma, et al., "RNA Interference: A Novel Tool for Plant Disease Management", African Journal of Biotechnology, Academic Journals, vol. 12, No. 18, May 1, 2013, 2303-2312.
Shmakov, et al., "Discovery and Functional Characterization of Diverse Class 2 CRISPR-Cas Systems", Molecular Cell, vol. 60, No. 3, Nov. 5, 2015, 385-397.
Smargon, et al., "Casl3B is a Type VI-B CRISPR-Associated RNA-Guided RNase Differentially Regulated by Accessory Proteins Csx27 and Csx28", Molecular Cell, vol. 65, No. 4, Feb. 16, 2017, 618-630.
Stovicek, et al., "CRISPR-Cas System Enables Fast and Simple Genome Editing of Industrial *Saccharomyces cerevisiae* Strains", Metabolic Engineering Communications, vol. 2, Dec. 2015, 13-22.
Sugano, et al., "CRISPR/Cas9-Mediated Targeted Mutagenesis in the *Liverwort marchantia polymorpha* L.", Plant and Cell Physiology, vol. 55, No. 3, 2014, 475-481.
Swiech, et al., "In Vivo Interrogation of Gene Function in the Mammalian Brain Using CRISPR-Cas9", Nature Biotechnology, vol. 33, No. 1, Jan. 2015, 102-106.
Tsai, et al., "Dimeric CRISPR RNA-Guided Fokl Nucleases for Highly Specific Genome Editing", Nature Biotechnology, vol. 32, No. 6, Jun. 2014, 569-577.
Wang, et al., "Enhanced Rice Blast Resistance by CRISPR/Cas9-Targeted Mutagenesis of the ERF Transcription Factor Gene OsERF922", PLoS One, vol. 11, No. 4, Apr. 26, 2016, 18 pages.
Wang, et al., "Genetic Screens in Human Cells Using the CRISPR/Cas9 System", Science, vol. 343, No. 6166, Jan. 3, 2014, 80-84.
Wang, et al., "One-Step Generation of Mice Carrying Mutations in Multiple Genes by CRISPR/Cas-Mediated Genome Engineering", Cell, vol. 153, No. 4, May 9, 2013, 910-918.
Witek, et al., "Accelerated Cloning of a Potato Late Blight-Resistance Gene Using RenSeq and SMRT Sequencing", Nature Biotechnology, vol. 34, No. 6, Jun. 2016, 656-660.
Woo, et al., "DNA-Free Genome Editing in Plants with Preassembled CRISPR-Cas9 Ribonucleoproteins", Nature Biotechnology, vol. 33, No. 11, Nov. 2015, 1162-1164.
Wroblewska, et al., "Mammalian Synthetic Circuits with RNA Binding Proteins for RNA-Only Delivery", Nature Biotechnology, vol. 33, No. 8, Aug. 2015, 839-841.
Wu, et al., "Genome-Wide Binding of the CRISPR Endonuclease Cas9 in Mammalian Cells", Nature Biotechnology, vol. 32, No. 7, Jul. 2014, 670-676.
Xie, et al., "RNA-Guided Genome Editing in Plants Using a CRISPR-Cas System", Molecular Plant, vol. 6, No. 6, Nov. 2013, 1975-1983.
Xing, et al., "A CRISPR/Cas9 Toolkit for Multiplex Genome Editing in Plants", BMC Plant Biology, vol. 14, No. 327, 2014, 12 pages.
Xu, et al., "Gene Targeting Using the Agrobacterium Tumefaciens-Mediated CRISPR-Cas System in Rice", Rice, vol. 7, No. 5, 2014, 4 pages.
Xu, et al., "Sequence Determinants of Improved CRISPR SgRNA Design", Genome Research, vol. 25, No. 8, Aug. 2015, 1147-1157.
Zahir, et al., "CRISPR/Cas9-Mediated Viral Interference in Plants", Genome Biology, vol. 16, No. 238, Nov. 11, 2015, 11 pages.
Zetsche, et al., "A Split-Cas9 Architecture for Inducible Genome Editing and Transcription Modulation", Nature Biotechnology, vol. 33, No. 2, Feb. 2015, 139-142.
Zetsche, et al., "Cpf1 is a Single RNA-Guided Endonuclease of a Class 2 CRISPR-Cas System", Cell, vol. 163, No. 3, Oct. 22, 2015, 759-771.
Zhang, et al., "A Highly Efficient Rice Green Tissue Protoplast System for Transient Gene Expression and Studying Light/Chloroplast-Related Processes", Plant Methods, vol. 7, No. 30, 2011.
Zhang, et al., "Structure-Based Prediction of Protein-Protein Interactions on a Genome-Wide Scale", Nature, vol. 490, Oct. 25, 2012, 556-560.
Zhou, et al., "Exploiting SNPs for Biallelic CRISPR Mutations in the Outcrossing Woody Perennial Populus Reveals 4-coumarate:CoA ligase Specificity and Redundancy", New Phytologist, vol. 208, Oct. 2015, 298-301.
Crotty, et al., "In Vivo RNAi Screens: Concepts and Applications". Trends in Immunology, vol. 36, No. 5, May 2015, 315-322.
"PCT International Search Report and Written Opinion issued in PCT/US2017/065438 mailed Feb. 12, 2018", Feb. 12, 2018, 1-13.
Abudayyeh, et al. "RNA targeting with CRISPR-Cas13a," Nature. Oct. 12, 2017; 550(7675): 280-284.
Aman, et al., "RNA virus interference via CRISPR/Cas13a system in plants," Genome Biology (2018) 19:1, all enclosed pages cited.
Zaidi, et al., "Engineering Plant Immunity: Using CRISPR/Cas9 to Generate Virus Resistance," Frontiers in Plant Science, Nov. 2016, vol. 7, Article 1673, all enclosed pages cited.

\* cited by examiner

CRISPR-SYSTEMS FOR MODIFYING A TRAIT OF INTEREST IN A PLANT

CROSS-REFERENCE TO RELATED APPLICATIONS

This application claims the benefit of U.S. Provisional Application No. 62/432,543 filed on Dec. 9, 2016, and U.S. Provisional Application No. 62/567,959 filed Oct. 4, 2017. The entire contents of the above-identified applications are hereby fully incorporated herein by reference.

STATEMENT AS TO FEDERALLY SPONSORED RESEARCH

This invention was made with government support under grant numbers MH100706 and MH110049 awarded by the National Institutes of Health, and grant number 73690-10507 awarded by the National Science Foundation. The government has certain rights in the invention.

FIELD OF THE INVENTION

The present invention generally relates to plants comprising a CRISPR system or parts of a CRISPR system, compositions, containers, polynucleotides, vectors, delivery systems, parts of plants, methods for production, CRISPR systems, and components thereof. Further aspects of the invention include a method for identifying a CRISPR system which is functional in a plant cell and a method for improving a CRISPR system in a plant.

BACKGROUND OF THE INVENTION

Plants are of particular importance in feeding the world's population, but they have also gained importance in other areas, for example in producing pharmaceutical products. For example, the use of plants for recombinant protein production has surged. In view of a rapidly growing global population, increasing food production and food quality are important. Major losses of crop yields and quality can result from infection of crops by plant disease pathogens including, in particular, viruses, bacteria, and fungi. In the past, available approaches for combating plant diseases were primarily limited to the selection of plants which exhibit genetic resistance to infection and the application of chemicals designed to protect plants from the organisms responsible for introducing the disease to the plant. Recent advances in genome sequencing techniques and analysis methods have significantly accelerated the ability to catalog and map genetic factors associated with a diverse range of biological functions and diseases. Precise targeting technologies are needed to enable selective perturbation of individual factors required for disease infection and propagation, as well as to advance synthetic biology and biotechnological applications. Although genome-editing techniques such as designer zinc fingers, transcription activator-like effectors (TALEs), or homing meganucleases are available for producing targeted genome perturbations and RNA interference (RNAi) based on small interfering RNAs (siRNAs) or short hairpin RNAs (shRNAs) can be used to target the transcriptome, there remains a need for new genome and transcriptome engineering technologies that employ novel strategies and molecular mechanisms and are affordable, easy to set up, scalable, and amenable to targeting multiple positions within the eukaryotic genome and transcriptome. This would provide a major resource for new applications in plant biotechnology, in particular also in combating plant diseases and specifically altering the production of chemical or biological products in plants in the context of food engineering and the production of pharmaceuticals.

The CRISPR-Cas systems of bacterial and archaeal adaptive immunity show extreme diversity of protein composition and genomic loci architecture. The CRISPR-Cas system loci has more than 50 gene families and there is no strictly universal genes indicating fast evolution and extreme diversity of loci architecture. So far, adopting a multi-pronged approach, there is comprehensive cas gene identification of at least 395 profiles for at least 93 Cas proteins. Classification includes signature gene profiles plus signatures of locus architecture. A classification of CRISPR-Cas systems is proposed in which these systems are broadly divided into two classes, Class 1 with multi-subunit effector complexes and Class 2 with single-subunit effector modules exemplified by the Cas9 protein. Novel effector proteins associated with Class 2 CRISPR-Cas systems may be developed as powerful engineering tools and the prediction of putative novel effector proteins and their engineering and optimization is important.

The CRISPR-Cas adaptive immune system defends microbes against foreign genetic elements via DNA or RNA-DNA interference. Recently, the Class 2 type VI single-component CRISPR-Cas effector C2c2 (Shmakov et al. (2015) "Discovery and Functional Characterization of Diverse Class 2 CRISPR-Cas Systems"; Molecular Cell 60:1-13; doi: http://dx.doi.org/10.1016/j.molcel.2015.10.008) was characterized as an RNA-guided RNase (Abudayyeh et al. (2016), Science, [Epub ahead of print], June 2; "C2c2 is a single-component programmable RNA-guided RNA-targeting CRISPR effector"; doi: 10.1126/science.aaf5573). C2c2 is also known as "Cas13a" and the two terms are used interchangeably herein. It was demonstrated that C2c2 (e.g. from *Leptotrichia shahii*) provides robust interference against RNA phage infection in bacteria. Through in vitro biochemical analysis and in vivo assays, it was shown that C2c2 can be programmed to cleave ssRNA targets carrying protospacers flanked by a 3' H (non-G) protospacer adjacent motif (PAM). Cleavage is mediated by catalytic residues in the two conserved HEPN domains of C2c2, mutations in which generate a catalytically inactive RNA-binding protein. C2c2 is guided by a single crRNA and can be re-programmed to deplete specific mRNAs in vivo. It was shown that LshC2c2 can be targeted to a specific site of interest and can carry out non-specific RNase activity once primed with the cognate target RNA. These results broaden our understanding of CRISPR-Cas systems and demonstrate the possibility of harnessing C2c2 to develop a broad set of RNA-targeting tools.

Citation or identification of any document in this application is not an admission that such document is available as prior art to the present invention. All documents cited, or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

SUMMARY OF THE INVENTION

There exists a pressing need for alternative and robust systems and techniques for targeting nucleic acids or polynucleotides (in particular RNA) with a wide array of applications, in particular in eukaryotic systems, more in particular in plant systems. This invention addresses this need and provides related advantages.

In the examples of the present patent application it has been shown for the first time that RNA targeting CRISPR effector proteins, such as Type VI CRISPR effector proteins including C2c2 (e.g. from Listeriaceae bacterium FSL M6-0635 (LbFSL), *Leptotrichia wadei* (Lw2), or Lachnospiraceae bacterium MA2020 (LbM)), can also be effectively employed to target RNA in plants, thus providing means for modifying a plant. This also allows the production of non-naturally occurring plants which are resistant to specific pathogens or wherein the amount of a specific biological or chemical product is enhanced or reduced.

Adding the novel RNA-targeting systems of the present application to the repertoire of genomic, transcriptomic, and epigenomic targeting technologies may transform the study and perturbation or editing of specific target sites through direct detection, analysis and manipulation, in particular in eukaryotic systems, more in particular in plant systems (including cells, organelles, tissues, or organisms). To utilize the RNA-targeting systems of the present application effectively for RNA targeting in plants without deleterious effects, it is critical to understand aspects of engineering and optimization of these RNA targeting tools.

The Class 2 type VI effector protein C2c2 is a RNA-guided RNase that can be efficiently programmed to degrade ssRNA (Abudayyeh et al (2016) "C2c2 is a single-component programmable RNA-guided RNA-targeting CRISPR effector", Science, 353(6299)):aaf5573; Shmakov et al. (2015) "Discovery and Functional Characterization of Diverse Class 2 CRISPR-Cas Systems", Mol Cell, 60(3): 385-97). C2c2 achieves RNA cleavage through conserved basic residues within its two HEPN domains, in contrast to the catalytic mechanisms of other known RNases found in CRISPR-Cas systems. Mutation of the HEPN domain, such as (e.g. alanine) substitution, any of the four predicted HEPN domain catalytic residues converted C2c2 into an inactive programmable RNA-binding protein (dC2c2, analogous to dCas9).

The ability of catalytically inactive RNA-targeting CRISPR effector proteins, such as for example dC2c2 as defined herein, to bind to specified sequences can also be used in several aspects according to the invention, including, but not limited to, (i) knock-down protein expression of one or more targeted mRNAs or alternatively interfere with non-coding RNA function (such as miRNA, lncRNA, rRNA, etc); (ii) bring effector modules to specific transcripts to modulate the function or translation, which could be used for large-scale screening, construction of synthetic regulatory circuits and other purposes; (iii) (fluorescently) tag specific RNAs to visualize their trafficking and/or localization; (iv) alter RNA localization through domains with affinity for specific subcellular compartments; (v) capture specific transcripts (through direct pull down of dC2c2 or use of dC2c2 to localize biotin ligase activity to specific RNAs) to enrich for proximal molecular partners, including RNAs and proteins; and (vi) RNA detection, such as involving target induced non-specific RNAse activity. In particular, the ability of catalytically inactive CRISPR effector proteins such as dC2c2 to bind to specified target RNA sequences can, for example, also be used to direct effectors to target RNAs of a plant pathogen and to thereby inhibit the replication and spread of the plant pathogen, to detect the presence of a plant pathogen via the presence of a target RNA specific for said plant pathogen or to target plant RNAs involved in the plant defense against the pathogen in order to upregulate the translation of plant RNAs encoding components actively involved in the plant's defense against the pathogen (e.g. target RNAs encoded by a plant resistance gene) or to downregulate the translation of plant RNAs required by the pathogen for infection and replication in the plant (e.g. target RNAs encoded by a plant susceptibility gene).

Active RNA-targeting CRISPR effector proteins such as C2c2 have many applications. An aspect of the invention involves targeting a specific transcript for destruction, as with actin and polyubiquitin here. In particular, target RNAs of plant pathogens can be targeted for destruction. In addition, C2c2, once primed by the cognate target, can cleave other (non-complementary) RNA molecules in vitro and can inhibit cell growth in vivo. Biologically, this promiscuous RNase activity may reflect a programmed cell death/dormancy (PCD/D)-based protection mechanism of the type VI CRISPR-Cas systems. Accordingly, in an aspect of the invention, it might be used to trigger PCD or dormancy in specific plant cells—for example, cells infected by a specific pathogen.

In addition, target induced non-specific RNase activity of a CRISPR effector protein such as C2c2 is useful to detect RNA species in samples. In the presence of an RNA target of interest, guide-dependent C2c2 nuclease activity is accompanied by non-specific RNAse activity against collateral targets. For example, a reporter RNA comprising a fluorescent moiety and a fluorescence quencher is non-specifically cleaved by activated C2c2. An RNA substrate is tagged with a fluorescent reporter molecule (fluorochrome) on one end and a quencher on the other. In the absence of C2c2 RNase activity, the physical proximity of the quencher dampens fluorescence from the fluorochrome to low levels. When C2c2 target specific cleavage is activated, the RNA substrate is non-specifically cleaved and the fluorochrome and quencher are spatially separated. This causes the fluorochrome to emit a signal when excited by light of the appropriate wavelength. This method could, for example, be employed to determine whether a plant is infected with a specific pathogen comprising the RNA target.

It will be appreciated that the terms Cas enzyme, CRISPR enzyme, CRISPR protein, CRISPR effector, CRISPR effector protein, Cas protein, Cas effector, RNA-targeting effector protein and CRISPR Cas are generally used interchangeably and at all points of reference herein refer by analogy to RNA-targeting CRISPR effector proteins further described in this application, unless otherwise apparent, such as by specific reference to Cas9. The CRISPR effector proteins described herein are preferably class 2, type VI effector proteins, more preferably C2c2 effector proteins.

The invention provides in one aspect a plant comprising a first component which is (a1) a Clustered Regularly Interspersed Short Palindromic Repeat (CRISPR) effector protein, and/or (a2) a polynucleotide encoding the CRISPR effector protein of (a1); and/or a second component which is (b1) a guide RNA (gRNA) comprising a guide sequence, and/or (b2) a polynucleotide encoding the gRNA of (b1), wherein the gRNA is capable of forming a complex with the CRISPR effector protein in said plant, and wherein the gRNA in said complex is capable of binding to a target RNA molecule. Preferably, the polynucleotide (a2) and (b2) is suitable to expresses said effector protein and said gRNA in said plant. Thus, if the plant comprises polynucleotides (a2) and (b2) then it is preferred that these polynucleotides cause the plant to produce said effector protein (a1) and said gRNA (b2) in said plant. The expression may be tissue-specific and/or inducible as described further herein. In a preferred embodiment, expression of the first and/or the second component is induced upon infection of the plant with a pathogen capable of infecting that plant. In such an embodiment, the expression of the first and/or the second component may be regulated by an plant pathogen defense promotor (preferably an endogenous plant pathogen defense promotor), e.g. the promotor of a resistance gene as described further herein. Preferably, the plant pathogen inducing the expression of the first and/or the second component is also targeted by the CRISPR system, i.e. the plant pathogen comprises or encodes the target RNA. As a result of expressing the CRISPR system, the plant may also exhibit a new or altered trait, such as, for example, increased expression of a biological product and/or resistance to a plant pathogen.

Further, the invention relates to a plant comprising (a) a Clustered Regularly Interspersed Short Palindromic Repeat (CRISPR) effector protein; and (b) a guide RNA (gRNA) which is in a complex with the CRISPR effector protein of (a); and wherein said guide RNA is capable of binding to a target RNA molecule from a pathogen that is capable of infecting said plant. In the above mentioned plant it is preferred that this plant also comprises polynucleotides (a2) and (b2). The plant pathogen may be a fungal pathogen, an oomycete, a bacterium, a virus, preferably an RNA virus, or a viroid. Preferably, the virus is an RNA virus or a DNA virus with an RNA intermediate. For example, the virus may be selected from the group comprising Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), *Citrus tristeza* virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis* mosaic virus (ArMV), or *Rupestris* stem pitting-associated virus (RSPaV). In a preferred embodiment, the target RNA molecule is part of said pathogen or transcribed from a DNA molecule of said pathogen. For example, the target sequence may be comprised in the genome of an RNA virus. It is further preferred that CRISPR effector protein cleaves said target RNA molecule of said pathogen in said plant if said pathogen infects or has infected said plant. It is thus preferred that the CRISPR system is capable of cleaving the target RNA molecule from the plant pathogen both when the CRISPR system (or parts needed for its completion) is applied therapeutically, i.e. after infection has occurred or prophylactically, i.e. before infection has occurred.

In a further aspect, the invention relates to a plant comprising a polynucleotide that expresses a Clustered Regularly Interspersed Short Palindromic Repeat (CRISPR) effector protein in one or more cells of said plant; wherein said CRISPR effector protein is a RNA-guided RNase; and said polynucleotide is codon optimized for expression in said one or more plant cells.

The CRISPR effector protein is an RNA-targeting CRISPR effector protein. The RNA-targeting CRISPR effector protein may be catalytically active, or alternatively catalytically inactive. Preferably, the CRISPR effector protein is a class 2, type VI effector protein. More preferably, the CRISPR effector protein is a C2c2 effector protein. In a further preferred embodiment, the C2c2 effector protein is derived from a bacterium belonging to (i) the phylum Firmicutes and preferably from the class Bacilli of said phylum, and most preferably from a Listeriaceae or Carnobacteriaceae bacterium or (ii) the phylum Bacteroidetes and preferably from the class Bacteroidia of said phylum, and most preferably from a *Paludibacter* bacterium. In one example embodiment, the CRISPR effector protein not derived from a bacterium belonging to the phylum Fusobacteria such as *Leptotrichia*. In another example embodiment, the CRISPR effector protein is deriving from a bacterium belonging to the phylum Fusobacteria. In particular embodiments, the CRISPR effector protein is a C2c2 effector protein selected from *Leptotrichia shahii* (Lsh), *Leptotrichia wadei* (Lw2), Lachnospiraceae bacterium MA2020 (LbM), Lachnospiraceae bacterium NK4A179 (LbNK4A179), *Clostridium aminophilum* DSM 10710 (Ca) and Listeriaceae bacterium FSL M6-0635 (LbFSL).

One or more amino acid residues of the effector protein may be modified, i.e. the CRISPR effector protein or C2c2 effector protein may be an engineered or non-naturally-occurring CRISPR effector protein or C2c2 effector protein. In an embodiment, the modification may comprise mutation of one or more amino acid residues of the effector protein. In embodiments where the CRISPR effector protein is only capable of binding to a target RNA but does not possess RNase activity, the one or more mutations may be in one or more catalytically active domains of the effector protein. The effector protein may for example have reduced or abolished nuclease activity compared with an effector protein lacking said one or more mutations. In a preferred embodiment, the CRISPR effector protein comprises two or more mutations. In particular embodiments, the CRISPR effector protein is C2c2 and the one or more mutated amino acid residues corresponding to R597, H602, R1278 and H1283 (referenced to Lsh C2c2 amino acids), such as mutations R597A, H602A, R1278A and H1283A, or the corresponding amino acid residues in Lsh C2c2 orthologues.

In particular embodiments, the one or more modified or mutated amino acid residues are one or more of those in C2c2 corresponding to K2, K39, V40, E479, L514, V518, N524, G534, K535, E580, L597, V602, D630, F676, L709, 1713, R717 (HEPN), N718, H722 (HEPN), E773, P823, V828, 1879, Y880, F884, Y997, L1001, F1009, L1013, Y1093, L1099, LIl11, Y1114, L1203, D1222, Y1244, L1250, L1253, K1261, 11334, L1355, L1359, R1362, Y1366, E1371, R1372, D1373, R1509 (HEPN), H1514 (HEPN), Y1543, D1544, K1546, K1548, V1551, 11558, according to C2c2 consensus numbering. In certain embodiments, the one or more modified or mutated amino acid residues are one or more of those in C2c2 corresponding to R717 and R1509. In certain embodiments, the one or more modified or mutated amino acid residues are one or more of those in C2c2 corresponding to K2, K39, K535, K1261, R1362, R1372, K1546 and K1548. In certain embodiments, said mutations result in a protein having an altered or modified activity. In certain embodiments, said mutations result in a protein having an increased activity, such as an increased specificity. In certain embodiments, said mutations result in a protein having a reduced activity, such as reduced specificity. In certain embodiments, said mutations result in a protein having no catalytic activity (i.e. "dead" CRISPR effector protein, e.g. "dead" C2c2 or dC2c2). In an embodiment, said amino acid residues correspond to Lsh C2c2 amino acid residues, or the corresponding amino acid residues of a C2c2 protein from a different species.

The invention also provides for the one or more mutations or the two or more mutations to be in a catalytically active domain of the CRISPR effector protein. In certain embodiments, the one or more mutations or the two or more mutations may be in a catalytically active domain of the CRISPR effector protein comprising a HEPN domain, or a catalytically active domain which is homologous to a HEPN domain. The CRISPR effector protein may comprise one or more heterologous functional domains. The one or more heterologous functional domains may comprise one or more nuclear localization signal (NLS) domains. The one or more heterologous functional domains may comprise at least two or more NLS domains. The one or more NLS domain(s) may be positioned at or near or in proximity to a terminus of the CRISPR effector protein (e.g., C2c2) and if two or more NLSs, each of the two may be positioned at or near or in proximity to a terminus of the effector protein (e.g., C2c2). The one or more heterologous functional domains may comprise one or more nuclear export signal (NES) domains. The one or more heterologous functional domains may comprise at least two or more NES domains. The one or more NES domain(s) may be positioned at or near or in proximity to a terminus of the effector protein (e.g., C2c2) and if two or more NESs, each of the two may be positioned at or near or in proximity to a terminus of the effector protein (e.g., C2c2). The one or more heterologous functional domains may comprise one or more translational activation domains. The one or more heterologous functional domains may comprise one or more nuclease domains.

The invention also provides for the one or more heterologous functional domains to have one or more of the following activities: methylase activity, demethylase activity, translation activation activity, translation repression activity, transcription activation activity, transcription repression activity, transcription release factor activity, histone modification activity, nuclease activity, single-strand RNA cleavage activity, double-strand RNA cleavage activity, single-strand DNA cleavage activity, double-strand DNA cleavage activity and nucleic acid binding activity. At least one or more heterologous functional domains may be at or near the amino-terminus of the effector protein and/or wherein at least one or more heterologous functional domains is at or near the carboxy-terminus of the effector protein. The one or more heterologous functional domains may be fused to the effector protein. The one or more heterologous functional domains may be tethered to the effector protein. The one or more heterologous functional domains may be linked to the effector protein by a linker moiety.

In preferred embodiments the CRISPR effector protein is from an organism of a genus selected from the group consisting of *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* and *Acidaminococcus*. The effector protein may comprise a chimeric effector protein comprising a first fragment from a first effector protein ortholog and a second fragment from a second effector protein ortholog, and wherein the first and second effector protein orthologs are different. At least one of the first and second effector protein orthologs may comprise an effector protein from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium, Lachnospiraceae, Clostridiaridium, Leptotrichia, Francisella, Legionella, Alicyclobacillus, Methanomethyophilus, Porphyromonas, Prevotella, Bacteroidetes, Helcococcus, Letospira, Desulfovibrio, Desulfonatronum, Opitutaceae, Tuberibacillus, Bacillus, Brevibacilus, Methylobacterium* or *Acidaminococcus*.

In certain embodiments, the CRISPR effector protein, may originate from a bacterial species belonging to the taxa alpha-proteobacteria, Bacilli, Clostridia, Fusobacteria and Bacteroidetes. In certain embodiments, the CRISPR effector protein, may originate from, may be isolated from, or may be derived from a bacterial species belonging to a genus selected from the group consisting of Lachnospiraceae, *Clostridium, Carnobacterium, Paludibacter, Listeria, Leptotrichia,* and *Rhodobacter*. In certain embodiments, the C2c2 effector protein may originate from a bacterial species selected from the group consisting of Lachnospiraceae bacterium MA2020, Lachnospiraceae bacterium NK4A179, *Clostridium aminophilum* (e.g., DSM 10710), Lachnospiraceae bacterium NK4A144, *Carnobacterium gallinarum* (e.g., DSM 4847 strain MT44), *Paludibacter propionicigenes* (e.g., WB4), *Listeria seeligeri* (e.g., serovar 1/2b str. SLCC3954), *Listeria weihenstephanensis* (e.g., FSL R9-0317 c4), *Listeria newyorkensis* (e.g., strain FSL M6-0635: "LbFSL"), *Leptotrichia wadei* (e.g., F0279: "Lw" or "Lw2"), *Leptotrichia buccalis* (e.g., DSM 1135), *Leptotrichia* sp. Oral taxon 225 (e.g., str. F0581), *Leptotrichia* sp. Oral taxon 879 (e.g., strain F0557), *Leptotrichia shahii* (e.g., DSM 19757), *Rhodobacter capsulatus* (e.g., SB 1003, R121, or DE442) *Leptotrichia buccalis* C-1013-b, *Herbinix hemicellulosilytica, Eubacterium rectale*, Eubacteriaceae bacterium CHKCI004, *Blautia* sp. Marseille-P2398, *Leptotrichia* sp. oral taxon 879 (e.g. str. F0557), Lachnospiraceae bacterium NK4A144, RNA-binding protein S1 *Chloroflexus aggregans, Demequina aurantiaca, Thalassospira* sp. TSL5-1, SAMN04487830_13920 *Pseudobutyrivibrio* sp. OR37, SAMN02910398_00008 *Butyrivibrio* sp. YAB3001, *Blautia* sp. Marseille-P2398, *Leptotrichia* sp. Marseille-P3007, *Bacteroides ihuae*, SAMN05216357_1045 Porphyromonadaceae bacterium KH3CP3RA, *Listeria riparia, Insolitispirillum peregrinum*. In certain preferred embodiments, the C2c2 effector protein originates from Listeriaceae bacterium (e.g. FSL M6-0635: "LbFSL"), Lachnospiraceae bacterium MA2020, Lachnospiraceae bacterium NK4A179, *Clostridium aminophilum* (e.g., DSM 10710), *Carnobacterium gallinarum* (e.g., DSM 4847), *Paludibacter propionicigenes* (e.g., WB4), *Listeria seeligeri* (e.g., serovar ½b str. SLCC3954), *Listeria weihenstephanensis* (e.g., FSL R9-0317 c4), *Leptotrichia wadei* (e.g., F0279: "Lw" or "Lw2"), *Leptotrichia shahii* (e.g., DSM 19757), *Rhodobacter capsulatus* (e.g., SB 1003, R121, or DE442); preferably Listeriaceae bacterium FSL M6-0635 (i.e. *Listeria newyorkensis* FSL M6-0635: "LbFSL"), *Leptotrichia wadei* (Lw2), Lachnospiraceae bacterium MA2020 (LbM), Lachnospiraceae bacterium NK4A179 (LbNK4179) or *Clostridium aminophilum* DSM 10710 (Ca), most preferably *Leptotrichia wadei* (Lw2) or Lachnospiraceae bacterium MA2020 (LbM).

In certain embodiments, a Type VI locus as disclosed herein may encode Cas1, Cas2, and the C2c2 effector protein.

In certain example embodiments, the RNA-targeting effector protein is a Type VI-B effector protein, such as Cas13b and Group 29 or Group 30 proteins. Regarding Type VI-B effector proteins, reference is made to U.S. application Ser. No. 15/331,792 entitled "Novel CRISPR Enzymes and Systems" and filed Oct. 21, 2016, International Patent Application No. PCT/US2016/058302 entitled "Novel CRISPR Enzymes and Systems", and filed Oct. 21, 2016, and Smargon et al. "Cas13b is a Type VI-B CRISPR-associated RNA-Guided RNase differentially regulated by accessory proteins Csx27 and Csx28" bioRxiv doi: 10.1101/092577.

In certain example embodiments, the RNA-targeting effector protein is a Cas13c effector protein, for example, as disclosed in U.S. Provisional Patent Application No. 62/525,165 filed Jun. 26, 2017, and International Application No. PCT/US2017/047193, filed Aug. 16, 2017.

In certain embodiments, the CRISPR effector protein used in the invention may be about 1000 to about 1500 amino acids long, such as about 1100 to about 1400 amino acids long, e.g., about 1000 to about 1100, about 1100 to about 1200 amino acids long, or about 1200 to about 1300 amino acids long, or about 1300 to about 1400 amino acids long, or about 1400 to about 1500 amino acids long, e.g., about 1000, about 1100, about 1200, about 1300, about 1400 or about 1500 amino acids long.

In certain embodiments, the CRISPR effector protein, comprises at least one and preferably at least two, such as more preferably exactly two, conserved RxxxxH motifs. Catalytic RxxxxH motifs are characteristic of HEPN (Higher Eukaryotes and Prokaryotes Nucleotide-binding) domains. Hence, in certain embodiments, the CRISPR effector protein, comprises at least one and preferably at least two, such as more preferably exactly two, HEPN domains. In certain embodiments, the HEPN domains may possess RNAse activity.

In certain embodiments, the CRISPR locus as intended herein may comprise CRISPR repeats between 30 and 40 bp long, more typically between 35 and 39 bp long, e.g., 30, 31, 32, 33, 34, 35, 36, 37, 38, 39, or 40 bp long. In particular embodiments, the direct repeat is at least 25 nt long.

In certain embodiments, a protospacer adjacent motif (PAM) or PAM-like motif directs binding of the effector protein complex as disclosed herein to the target sequence. In some embodiments, the PAM may be a 5' PAM (i.e., located upstream of the 5' end of the protospacer). In other embodiments, the PAM may be a 3' PAM (i.e., located downstream of the 5' end of the protospacer). The term "PAM" may be used interchangeably with the term "PFS" or "protospacer flanking site" or "protospacer flanking sequence".

In a preferred embodiment, the CRISPR effector protein may recognize a 3' PAM.

In certain embodiments, the CRISPR enzyme is engineered and can comprise one or more mutations that reduce or eliminate a nuclease activity as also described above. Mutations can also be included at neighboring residues, e.g., at amino acids near those indicated above that participate in the nuclease activity. In some embodiments, only one HEPN domain is inactivated, and in other embodiments, a second HEPN domain is inactivated.

The invention also provides for the nucleotide sequence encoding the effector protein being codon optimized for expression in a eukaryote or eukaryotic cell in any of the herein aspects. In an embodiment of the invention, the codon optimized nucleotide sequence encoding the effector protein encodes any C2c2 discussed herein and is codon optimized for operability in a eukaryotic cell or organism, e.g., such a plant or plant cell. In preferred embodiments of the present invention, the polynucleotide encoding the CRISPR effector protein and/or the polynucleotide encoding the gRNA(s) may be codon optimized for expression in the plant cell or plant of the invention.

In certain embodiments of the invention, at least one nuclear localization signal (NLS) is attached to the nucleic acid sequences encoding the CRISPR effector proteins. In preferred embodiments at least one or more C-terminal or N-terminal NLSs are attached (and hence nucleic acid molecule(s) coding for the CRISPR effector protein can include coding for NLS(s) so that the expressed product has the NLS(s) attached or connected). In certain embodiments of the invention, at least one nuclear export signal (NES) is attached to the nucleic acid sequences encoding the CRISPR effector proteins. In preferred embodiments, at least one or more C-terminal or N-terminal NESs are attached (and hence nucleic acid molecule(s) coding for the CRISPR effector protein can include sequences coding for NES(s) so that the expressed product has the NES(s) attached or connected). In a preferred embodiment, a C-terminal and/or N-terminal NLS or NES is attached for optimal expression and nuclear targeting in eukaryotic cells, preferably plant cells. In a preferred embodiment, the codon optimized effector protein is C2c2 and the spacer length of the guide RNA is from 15 to 35 nt. In certain embodiments, the spacer length of the guide RNA is at least 16 nucleotides, such as at least 17 nucleotides, preferably at least 18 nt, such as preferably at least 19 nt, at least 20 nt, at least 21 nt, or at least 22 nt. In certain embodiments, the spacer length is from 15 to 17 nt, from 17 to 20 nt, from 20 to 24 nt, e.g., 20, 21, 22, 23, or 24 nt, from 23 to 25 nt, e.g., 23, 24, or 25 nt, from 24 to 27 nt, from 27-30 nt, from 30-35 nt, or 35 nt or longer. In certain embodiments of the invention, the codon optimized effector protein is C2c2 and the direct repeat length of the guide RNA is at least 16 nucleotides. In certain embodiments, the codon optimized effector protein is C2c2 and the direct repeat length of the guide RNA is from 16 to 20 nt, e.g., 16, 17, 18, 19, or 20 nucleotides. In certain preferred embodiments, the direct repeat length of the guide RNA is 19 nucleotides.

In addition to the CRISPR effector protein, the CRISPR system comprises one or more nucleic acid components. The one or more nucleic acid components comprise the nucleic acid components required by the CRISPR effector protein in order to form a CRISPR system, that is able to bind to a target RNA and to exert a function on said target RNA, such as at least a guide RNA (gRNA). The CRISPR effector protein forms a complex with the one or more nucleic acid components and upon binding of the said complex to the target sequence, the effector protein induces the modification of sequences associated with or at the target sequence. In a preferred embodiment, the modification is the introduction of a strand break. In a preferred embodiment, the CRISPR effector protein forms a complex with one nucleic acid component; advantageously an engineered or non-naturally occurring nucleic acid component. The induction of modification of sequences associated with or at the target sequence can be CRISPR effector protein-nucleic acid guided. The CRISPR system is preferably capable of exerting a function upon the target RNA upon binding thereto. For example, the complex comprising the CRISPR effector protein and the gRNA may upon binding to the target RNA molecule in a plant of the invention, be capable of (i) cleaving said target RNA molecule, (ii) increasing the translation of said target RNA molecule, (iii) reducing the translation of said target RNA molecule or (iv) modulating the splicing of said target RNA molecule.

In a preferred embodiment, the one nucleic acid component is a CRISPR RNA (crRNA). In a preferred embodiment, the one nucleic acid component is a mature crRNA or guide RNA, wherein the mature crRNA or guide RNA comprises a spacer sequence (or guide sequence) and a direct repeat sequence or derivatives thereof. In a preferred embodiment, the spacer sequence or the derivative thereof comprises a seed sequence, wherein the seed sequence is critical for recognition and/or hybridization to the sequence at the target sequence. Preferably, the guide RNA mediates specific binding of the CRISPR system to a target RNA in a plant, i.e., the gRNA binds with higher affinity to the target RNA molecule than to any other RNA molecule from said plant.

Aspects of the invention relate to CRISPR effector protein complexes having one or more non-naturally occurring or engineered or modified or optimized nucleic acid components. In a preferred embodiment, a nucleic acid component of the complex may comprise a guide sequence linked to a direct repeat sequence, wherein the direct repeat sequence comprises one or more stem loops or optimized secondary structures. In certain embodiments, the direct repeat has a minimum length of 16 nts, such as at least 28 nt, and a single stem loop. In further embodiments, the direct repeat has a length longer than 16 nts, preferably more than 17 nts, such as at least 28 nt, and has more than one stem loop or optimized secondary structures. In particular embodiments, the direct repeat has 25 or more nts, such as 26 nt, 27 nt, 28 nt or more, and one or more stem loop structures. In a preferred embodiment, the direct repeat may be modified to comprise one or more protein-binding RNA aptamers. In a preferred embodiment, one or more aptamers may be included such as part of optimized secondary structure. Such aptamers may be capable of binding a bacteriophage coat protein. The bacteriophage coat protein may be selected from the group comprising Qβ, F2, GA, fr, JP501, MS2, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. In a preferred embodiment, the bacteriophage coat protein is MS2. The invention also provides for the nucleic acid component of the complex being 30 or more, 40 or more or 50 or more nucleotides in length.

In a preferred embodiment, the CRISPR system may comprise more than one gRNA for multiplexed use. The gRNAs may be different and may target different regions within the same target RNA or within different target RNAs. In other words, the different gRNAs may differ from one another in their ability to hybridize to a specific target RNA. The different target RNAs may be from the same or from different organsims, such as, for example, from the same plant pathogen or from different plant pathogens. In a preferred embodiment, the CRISPR system comprises different gRNAs specific for different target sequences and the different target sequences are located in multiple regions of a target RNA from a plant pathogen; different target RNAs from the same plant pathogen; or different target RNAs from different plant pathogens.

In a preferred embodiment, the polynucleotide encoding the CRISPR effector protein and/or the polynucleotide comprising or encoding the nucleic acid component(s) of the CRISPR system, in particular the gRNA, is/are stably integrated into the genome of the plant. Such a plant is also referred to herein as a "transgenic plant" (see also definition elsewhere in this description).

The plant of the invention comprises a CRISPR effector protein which does not naturally occur in plants. Thus, said plant is an engineered plant. In a further preferred embodiment, the plant is selected from the group consisting of *Oryza sativa*, *Solanum tuberosum*, *Solanum lycopersicum*, *Zea mays*, *Triticum* spp., *Triticum aestivum*, *Sorghum bicolor*, *Dioscorea* spp., *Musa* spp., *Manihot esculenta*, *Glycine max*, *Gossypium hirsutum*, *Hordeum vulgare*, *Avena sativa*, *Secale cereale*, *Brassica rapa*, or *Brassica napus*. In a preferred embodiment, the plant is a cereal plant, a pseudocereal plant or a vegetable plant.

Preferably, the plant of the invention exhibits increased resistance to a plant pathogen. Additionally or alternatively, the plant of the invention may produce more or less of a specific biological or chemical product. The biological or chemical product may be an endogenous or exogenous product. For example, the product may be a compound that influences the nutritional value or the taste of the plant. Alternatively, the product may, for example, be a pharmaceutical product such as a drug or an antibody.

The target sequence may be comprised within an RNA molecule, i.e. the target RNA. Also, the target sequence may be, in certain embodiments, within a transcribed DNA molecule. In such embodiments, the target sequence may be comprised in a nucleic acid molecule in vitro. In a preferred embodiment, the target RNA, i.e. the RNA molecule comprising the target sequence to which the gRNA can hybridize, may be comprised in or encoded by the genome of a plant pathogen. In another preferred embodiment, the target sequence comprised by a target RNA that is encoded by a susceptibility gene of a plant. In another preferred embodiment, the target sequence comprised by a target RNA that is encoded by a resistance gene of a plant. The target sequence may be comprised in a nucleic acid molecule within a cell, in particular, a eukaryotic cell, such as a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced. In certain embodiments, the modification of the target RNA may result in: the plant comprising altered (protein) expression of at least one gene product; the plant cell comprising altered (protein) expression of at least one gene product, wherein the (protein) expression of the at least one gene product is increased; the plant cell comprising altered (protein) expression of at least one gene product, wherein the (protein) expression of the at least one gene product is decreased; or the plant cell comprising an edited transcriptome. In particular, the modification introduced to the cell by the present invention may be such that resistance to one or more plant pathogens is conveyed or enhanced.

The plant cell may be of a monocot or dicot or of a crop or grain plant such as cassava, corn, sorghum, soybean, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus *Lactuca*; plants of the genus *Spinacia*; plants of the genus *Capsicum*; cotton, tobacco, asparagus, carrot, cabbage, broccoli, cauliflower, tomato, eggplant, pepper, lettuce, spinach, strawberry, blueberry, raspberry, blackberry, grape, coffee, cocoa, etc).

In a further aspect, the invention also provides a plant part of the plant of the invention. In a preferred embodiment, the plant part is selected from the group consisting of a plant cell, a somatic embryo, a pollen, a gametophyte, an ovule, a leaf, a seedling, a stem, a callus, a stolon, a microtuber, a shoot, a seed, a fruit and a spore. Preferably, the plant part is a fruit or a seed. The plant part may also be a plant cell. The plant cell may be a protoplast. In a preferred embodiment, the protoplast is a rice protoplast. In a further aspect, the invention relates to a plant cell line comprising the plant cell of the invention or progeny thereof.

In another aspect, the invention relates to a composition comprising at least two plant parts. Preferably, the composition comprises at least two, at least five, at least ten, at least fifty, at least one hundred or at least one thousand plant parts of the invention. Preferably, the composition may comprise at least 2, at least 5, at least 10, at least 50, at least 100 or at least 1000 seeds, fruits or spores.

In a further aspect, the invention also relates to a processed product comprising a plant or plant part of the invention. Such a processed product may be obtained by subjecting the plant or plant part of the invention to one or more processing steps, which may, for example, include washing, peeling, cutting, seasoning, concentrating, pressing, drying, dehyrdating, freezing, heating, preserving, e.g. by pasteurizing, pickling, salting or the like, and/or packaging of the plant or plant part of the invention, e.g. canning, or combining it with additional ingredients such as additional salt, sugar or fat. Preferably, the processed product is a foodstuff.

The invention also provides a packaging comprising the plant of the invention, the plant part of the invention or the composition of the invention. The packaging may be any type of material that at least partially covers or encompasses the plant, plant part or composition of the invention. A packaging according to the invention is preferably a packaging selected from the group consisting of a bag, a box, a carton, a case, a tray, a can, a roll and a wrapping.

In any of the described methods, the effector protein and nucleic acid components may be provided via one or more polynucleotide molecules encoding the protein and/or nucleic acid component(s), and wherein the one or more polynucleotide molecules are operably configured to express the protein and/or the nucleic acid component(s). The one or more polynucleotide molecules may comprise one or more regulatory elements operably configured to express the protein and/or the nucleic acid component(s). The one or more polynucleotide molecules may be comprised within one or more vectors. In any of the described methods, the complex may be delivered with multiple guides for multiplexed use. In any of the described methods, more than one protein(s) may be used.

The invention also provides a non-naturally occurring or engineered composition, which is a composition having the characteristics as discussed herein or defined in any of the herein described methods.

The invention also relates to an engineered or non-naturally occurring Clustered Regularly Interspersed Short Palindromic Repeat (CRISPR) system comprising a first component which is (a1) a CRISPR effector protein, or (a2) a polynucleotide encoding the CRISPR effector protein of (a1); and a second component which is (b1) a guide RNA (gRNA) comprising a guide sequence, or (b2) a polynucleotide encoding the gRNA of (b1), wherein the gRNA is capable of forming a complex with the CRISPR effector protein in a plant, and wherein the gRNA in said complex is capable of binding to a target RNA molecule. In certain embodiments, the invention thus provides a non-naturally occurring or engineered CRISPR system, such as particularly a system capable of or configured to modify a target sequence, said composition comprising a CRISPR effector protein and one or more nucleic acid components, wherein the effector protein is capable of forming a complex with the one or more nucleic acid components and, upon binding of the said complex to the target sequence, the effector protein induces the modification of the target RNA comprising the target sequence.

The invention also provides in a further aspect a non-naturally occurring or engineered composition, such as particularly a composition capable of or configured to modify a target RNA, said composition comprising: (a) a guide RNA molecule (or a combination of guide RNA molecules, e.g., a first guide RNA molecule and a second guide RNA molecule, such as for multiplexing) or a nucleic acid encoding the guide RNA molecule (or one or more nucleic acids encoding the combination of guide RNA molecules); (b) a C2c2 effector protein or a nucleic acid encoding the C2c2 effector protein.

The invention also provides in a further aspect a polynucleotide comprising the polynucleotide encoding a CRISPR effector protein and the polynucleotide comprising (or encoding) the nucleic acid components of a CRISPR system of the invention, in particular the gRNA.

Further, the invention relates to a vector comprising the polynucleotide of the invention. In addition, the vector may comprise at least one regulatory element. In the vector, the polynucleotide and the regulatory element are operably connected. Regulatory elements may comprise constitutive or inducible promoters. In a preferred embodiment, the vector is a plant viral vector. In a preferred embodiment, the vector comprises a promotor selected from the group consisting of a plant actin promotor, a plant U6 promotor and a CaMV 35 S promotor which drives the transcription of (a2) and/or (b2). In a more preferred embodiment, the polynucleotide encoding the CRISPR effector protein is under the control of a rice actin promoter if the plant is a monocot plant and under the control of a 35S promoter if the plant is a dicot plant. Further, it is preferred that the gRNA is under the control of a U6 promotor. Preferably, in monocots a rice U6 promoter and in dicots an *arabidopsis* U6 promoter is used.

The invention also provides a vector system comprising one or more vectors, the one or more vectors comprising one or more polynucleotide molecules encoding components of a non-naturally occurring or engineered CRISPR system, which is a system having the characteristics as defined in any of the herein described aspects. In particular, in a further aspect, the invention provides a vector system comprising a first vector comprising a polynucleotide encoding a CRISPR effector protein and a second vector comprising (or encoding) the nucleic acid components, in particular the gRNA, of a CRISPR system as described herein above. In a preferred embodiment, the first and/or the second vector is a plant viral vector.

The invention also provides a delivery system comprising one or more vectors or one or more polynucleotide molecules, the one or more vectors or polynucleotide molecules comprising one or more polynucleotide molecules encoding components of a non-naturally occurring or engineered CRISPR system, which is a system having the characteristics discussed herein or as defined in any of the herein described aspects. Specifically, the invention relates to a delivery system comprising the non-naturally occurring or engineered system of the invention, the polynucleotide of the invention, the vector of the invention or the vector system of the invention. The delivery system may, for example, be *Agrobacterium tumefaciens*. Accordingly, the invention also relates to an engineered *Agrobacterium* comprising one or more vectors or one or more polynucleotide molecules, the one or more vectors or polynucleotide molecules comprising one or more polynucleotide molecules encoding components of a non-naturally occurring or engineered CRISPR system, which is a system having the characteristics discussed herein or as defined in any of the herein described aspects. In one embodiment, the one or more vectors or polynucleotide molecules are configured for *Agrobacterium* mediated transformation. See Stanton B. Gelvin, Microbiol Mol Biol Rev. 2003 March; 67(1): 16-37.

The invention further provides a method for producing a plant cell wherein the amount of a target RNA or translation of a target RNA is modified, comprising delivering the non-naturally occurring or engineered composition system of the invention, the polynucleotide of the invention, the vector of the invention, or the vector system of the invention into said plant cell.

In a further aspect, the invention provides a method for producing a plant wherein the amount of a target RNA or translation of a target RNA is modified comprising (a) producing a plant cell according to the method of the invention described herein and regenerating a plant from said plant cell; or (b) delivering the non-naturally occurring or engineered system of the invention, the polynucleotide of the invention, the vector of the invention or the vector system of the invention into one or more cells of the plant. The produced plant has the same characteristics described for the plant of the invention herein.

In further embodiments, the non-naturally occurring or engineered system, the polynucleotide, the vector, vector systems, or the delivery systems as described in the present specification may be used for RNA sequence-specific interference, RNA sequence specific modulation of expression (including isoform specific expression), stability, localization, functionality (e.g. ribosomal RNAs or miRNAs), etc.; or multiplexing of such processes. In a further aspect, the invention relates to the use of the non-naturally occurring or engineered composition system of the invention, the polynucleotide of the invention, the vector of the invention, the vector system of the invention or the delivery system of the invention for producing a plant cell, a plant cell line, a plant part or a plant wherein the amount of a target RNA or translation of a target RNA is modified. The modification of the target RNA may lead to a plant cell, plant part or plant having a new or enhanced trait such as, e.g., resistance to a plant pathogen.

In further embodiments, the non-naturally occurring or engineered compositions, the vector systems, or the delivery systems as described in the present specification may be used for RNA detection and/or quantification within a cell. In particular, by detecting a target RNA of a plant pathogen it may be determined whether a cell is infected with said plant pathogen.

In further embodiments, the non-naturally occurring or engineered compositions, the vector systems, or the delivery systems as described in the present specification may be used for: site-specific transcriptome editing or perturbation or nucleic acid sequence-specific interference; or multiplexing of such processes.

Also provided is a gene product from the cell, the cell line, or the organism as described herein. In certain embodiments, the amount of gene product expressed may be greater than or less than the amount of gene product from a cell that does not have altered expression. In certain embodiments, the gene product may be altered in comparison with the gene product from a cell that does not have altered expression.

The invention also relates to use of a CRISPR system, which is an RNA-guided RNase for inducing cell death in a plant cell infected with a plant pathogen. The induction of cell death may be mediated by the collateral activity exhibited by the CRISPR effector protein once activated by the presence of a target RNA from the plant pathogen infecting the plant cell. In a preferred embodiment, the target RNA from the plant pathogen is specific for said plant pathogen and is absent from plant cells not infected with said pathogen. Preferably, the CRISPR effector protein is used in combination with a gRNA capable of hybridizing under stringent conditions to the target RNA from the plant pathogen. In a preferred embodiment, the CRISPR effector protein is a C2c2 effector protein.

In addition, the invention relates to the use of the (non-naturally occurring or engineered) system of the invention, the polynucleotide of the invention, the vector of the invention, the vector system or the delivery system of the invention for treating, preventing or ameliorating plant disease in a plant. The invention also relates to a method for treating, preventing or ameliorating plant disease in a plant comprising delivering the (non-naturally occurring or engineered) system of the invention, the polynucleotide of the invention, the vector of the invention and/or the vector system of the invention to the plant. Delivery may occur prior or subsequent to the invention, i.e. the use may be a prophylactic or a therapeutic use. Further, the invention relates to the use of the (non-naturally occurring or engineered) system of the invention, the polynucleotide of the invention, the vector of the invention, the vector system or the delivery system of the invention for inducing, promoting, or improving plant resistance to a plant pathogen. Furthermore, the invention relates to a method of inducing, promoting, or improving plant resistance to a plant pathogen comprising delivering the (non-naturally occurring or engineered) system of the invention, the polynucleotide of the invention, the vector of the invention and/or the vector system of the invention to the plant.

Further, the invention also relates to a method of inducing cell death in a plant cell infected with a plant pathogen comprising the steps of delivering a CRISPR system of the invention into said plant. Delivery may occur prior or subsequent to the infection.

In a further aspect, the invention provides a method for identifying a CRISPR system which is functional in a plant cell comprising the steps (a) expressing a CRISPR effector protein candidate in the plant cell; (b) providing a gRNA to form a complex with the CRISPR effector protein candidate in said plant cell; (c) quantifying target RNA in the plant cell, where said target RNA is an RNA to which the gRNA in said complex can bind in the plant cell; and (d) selecting said candidate if the quantity determined in c) is reduced as compared to a plant cell having no CRISPR effector protein and/or no gRNA.

In a further aspect, the invention provides a method for targeted breeding of plants (a) expressing a CRISPR effector protein in a plurality of plant cells; (b) providing a gRNA to form a complex with the CRISPR effector protein in said plant cells; (c) quantifying target RNA in the plant cells, where said target RNA is an RNA to which the gRNA in said complex can bind in the plant cells; and (d) selecting a plant cell if the quantity determined in c) is reduced as compared to a plant cell or plant having no CRISPR effector protein and/or no gRNA. In a preferred embodiment, the method comprises the further step or steps of (e) regenerating the plant cell selected in (d) into a plurality of plants and optionally (f) using the plants regenerated in step (e) in breeding. In a further aspect, the invention provides a method for targeted breeding of plants (a) expressing a CRISPR effector protein in a plurality of plant cells; (b) providing a gRNA to form a complex with the CRISPR effector protein in said plant cells; (c) regenerating the plant cells into a plurality of plants; (d) assessing a phenotype associated with a target RNA to which the gRNA in said complex can bind in the plant cells; and (e) selecting a plant having alteration to said phenotype compared to a plant having no CRISPR effector protein and/or no gRNA. In a preferred embodiment of the aforementioned aspect, the method further comprises a step (f) of using the plant selected in (e) in breeding further plants.

In any of the aspects of the invention, the CRISPR effector protein is an RNA-targeting effector protein that may be catalytically active or inactive. In a preferred embodiment, the CRISPR effector protein is a C2c2 effector protein. The C2c2 effector protein may, for example, be selected from the group comprising *Leptotrichia shahii* C2c2, *Leptotrichia wadei* F0279 (Lw2) C2c2, *Listeria seeligeri* C2c2, Lachnospiraceae bacterium MA2020 C2c2, Lachnospiraceae bacterium NK4A179 C2c2, *Clostridium aminophilum* DSM 10710 C2c2, *Carnobacterium gallinarum* DSM 4847 C2c2, *Paludibacter propionicigenes* WB4 C2c2, *Listeria weihenstephanensis* FSL R9-0317 C2c2, Listeriaceae bacterium FSL M6-0635 C2c2, *Leptotrichia wadei* F0279 C2c2, *Rhodobacter capsulatus* SB 1003 C2c2, *Rhodobacter capsulatus* R121 C2c2, *Rhodobacter capsulatus* DE442 C2c2 *Leptotrichia buccalis* C-1013-b C2c2, *Herbinix hemicellulosilytica* C2c2, *Eubacterium rectale* C2c2, Eubacteriaceae bacterium CHKCI004 C2c2, *Blautia* sp. Marseille-P2398 C2c2, *Leptotrichia* sp. oral taxon 879 str. F0557 C2c2, Lachnospiraceae bacterium NK4A144 C2c2, RNA-binding protein S1 *Chloroflexus aggregans* C2c2, *Demequina aurantiaca* C2c2, *Thalassospira* sp. TSL5-1 C2c2, SAMN04487830_13920 *Pseudobutyrivibrio* sp. OR37 C2c2, SAMN02910398_00008 *Butyrivibrio* sp. YAB3001 C2c2, *Blautia* sp. Marseille-P2398 C2c2, *Leptotrichia* sp. Marseille-P3007 C2c2, *Bacteroides ihuae* C2c2, SAMN05216357_1045 Porphyromonadaceae bacterium KH3CP3RA C2c2, *Listeria riparia* C2c2, *Insolitispirillum peregrinum* C2c2. In a preferred embodiment, the C2c2 effector protein is Listeriaceae bacterium FSL M6-0635 C2c2 (LbFSL), *Leptotrichia wadei* C2c2 (Lw2), Lachnospiraceae bacterium MA2020 C2c2 (LbM), Lachnospiraceae bacterium NK4A179 C2c2 (LbNK4179) or *Clostridium aminophilum* DSM 10710 C2c2 (Ca), most preferably *Leptotrichia wadei* C2c2 (Lw2), or Lachnospiraceae bacterium MA2020 C2c2 (LbM). Alternatively, the CRISPR effector may be an effector protein having RNase activity when in complex with a gRNA and a target RNA and having an amino acid sequence identity to any of SEQ ID NO: 1 to 15 of at least 90%. In a particularly preferred embodiment, the plant is rice (e.g. *Oryza sativa*) and the CRISPR effector protein is selected from *Leptotrichia wadei* C2c2 (Lw2) and Lachnospiraceae bacterium MA2020 C2c2 (LbM).

The CRISPR system may comprise more than one CRISPR effector protein. In a preferred embodiment, the CRISPR system may comprise more than one gRNA for multiplexed use. In that case, the gRNAs may differ from one another and may bind to different target sequences. These target sequences may be located within the same target RNA molecule or in different target RNA molecules, with the target RNA molecules being of the same organism or of different organisms such as, for example, from different plant pathogens.

The invention also relates to a method for improving a CRISPR system in a plant comprising the steps of (a) expressing a CRISPR effector protein in a plant cell; (b) providing a gRNA to form a complex with the CRISPR effector protein of (a) in said plant cell; (c) quantifying target RNA in the plant cell, where said target RNA is an RNA to which the gRNA in said complex can bind in the plant cell; and (d) comparing the quantified target RNA in (c) with the target RNA quantified in another plant cell that comprises the target RNA, the CRISPR effector protein and the gRNA, except that either the CRISPR effector protein or the gRNA has been modified compared to the versions used in step (a) and (b); and (e) determining whether the modification in (d) results in a different target RNA amount in said cell.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 2A: pAtU6-Lsh-gRNA-ccdB; FIG. 2B: pCaMV35S-Lsh-C2c2-HSP; FIG. 2C: pOsActin-Lsh-C2c2-HSP; FIG. 2D: pOsU6-Lsh-gRNA-ccdB as described in examples 1-3.

DETAILED DESCRIPTION OF THE INVENTION

Figure 1:
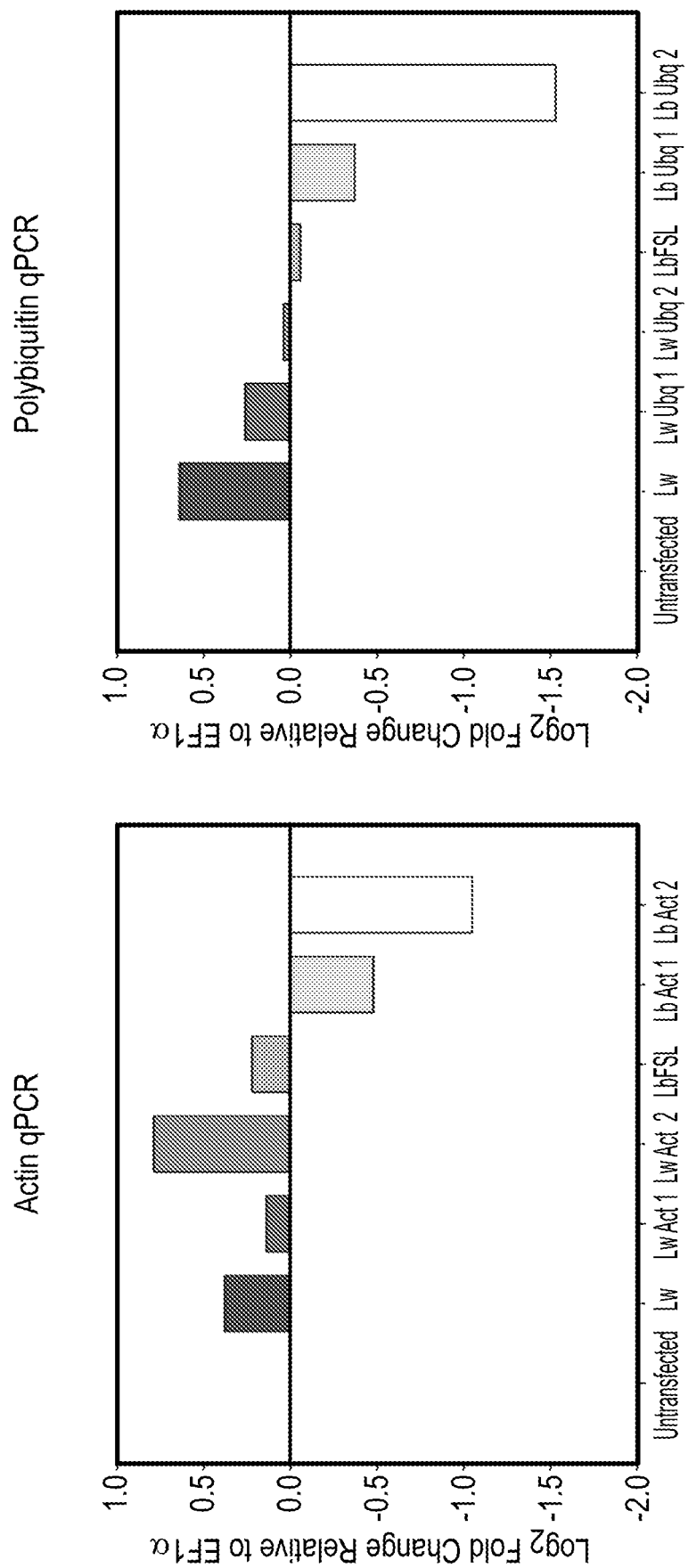
FIG. 1. shows C2c2 mediated knockdown in plant cells. The expression of actin and polyubiquitin relative to EF1α expression (negative control) obtained in the plant cells transfected with the C2c2 alone (Lw and LbFSL), or with the indicated C2c2 as well as gRNA is shown.
Figure 2A:
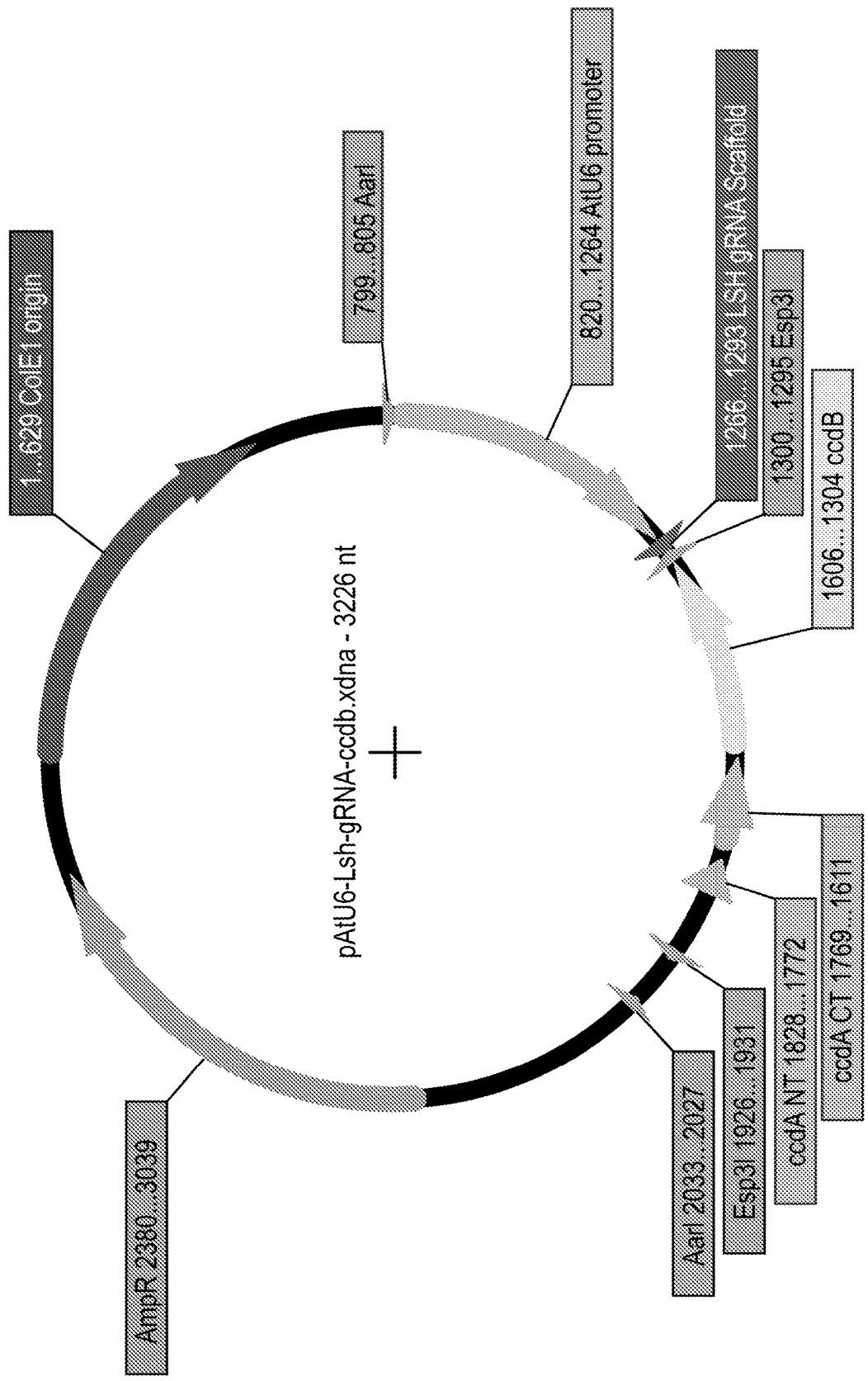
FIGS. 2A-2D show exemplary plasmid maps used for plant transformation
Figure 2B:
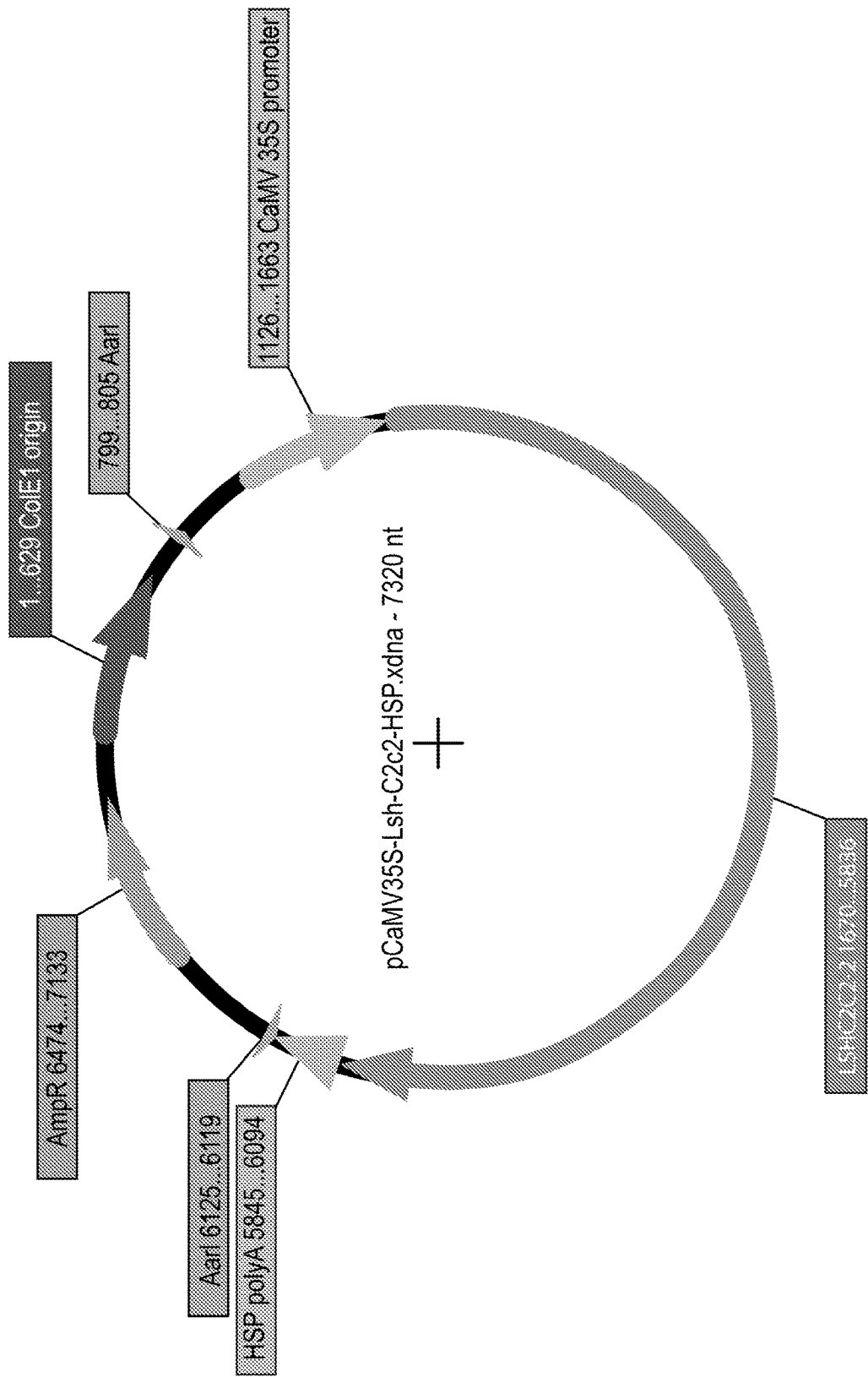
Figure 2C:
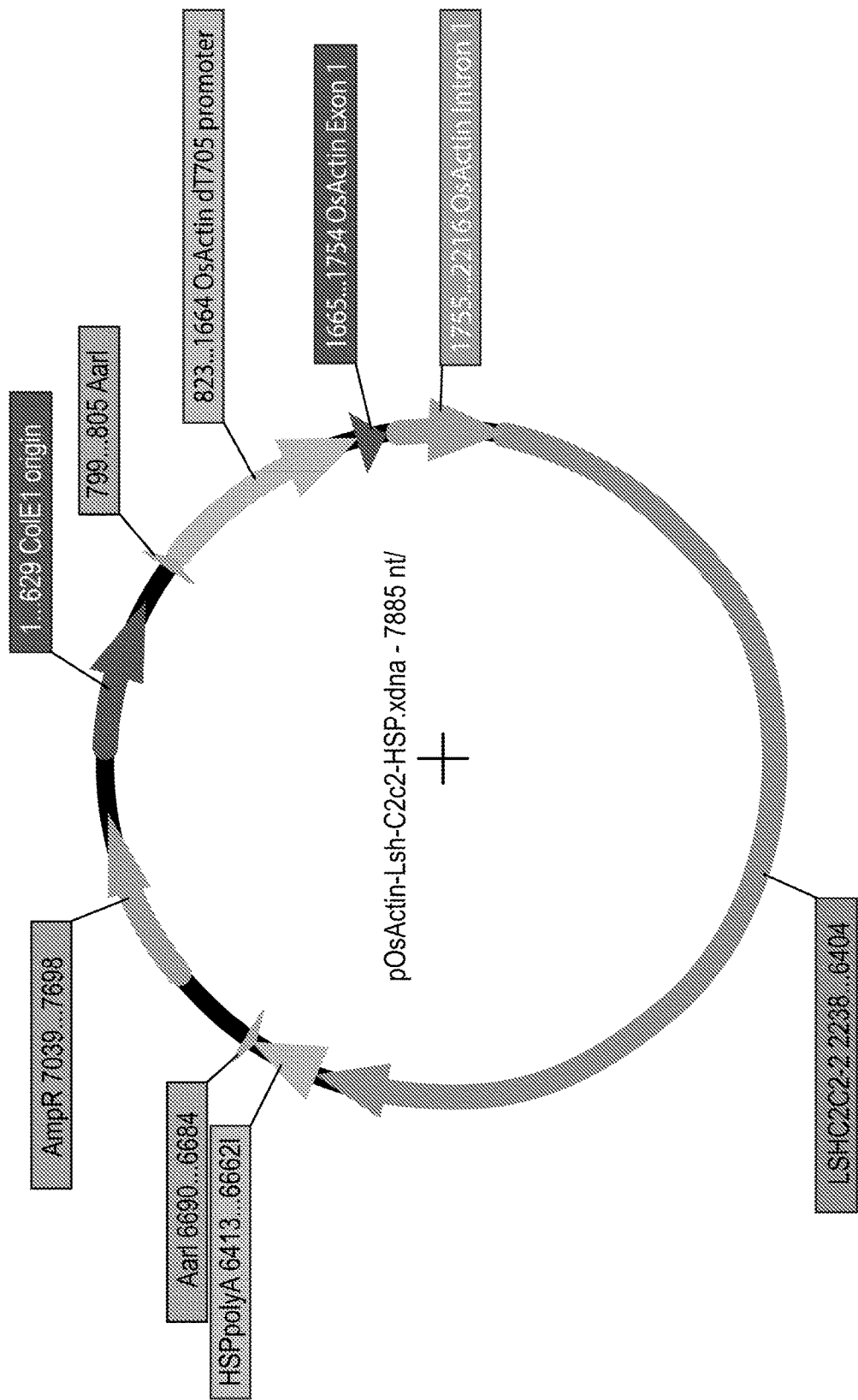
Figure 2D:
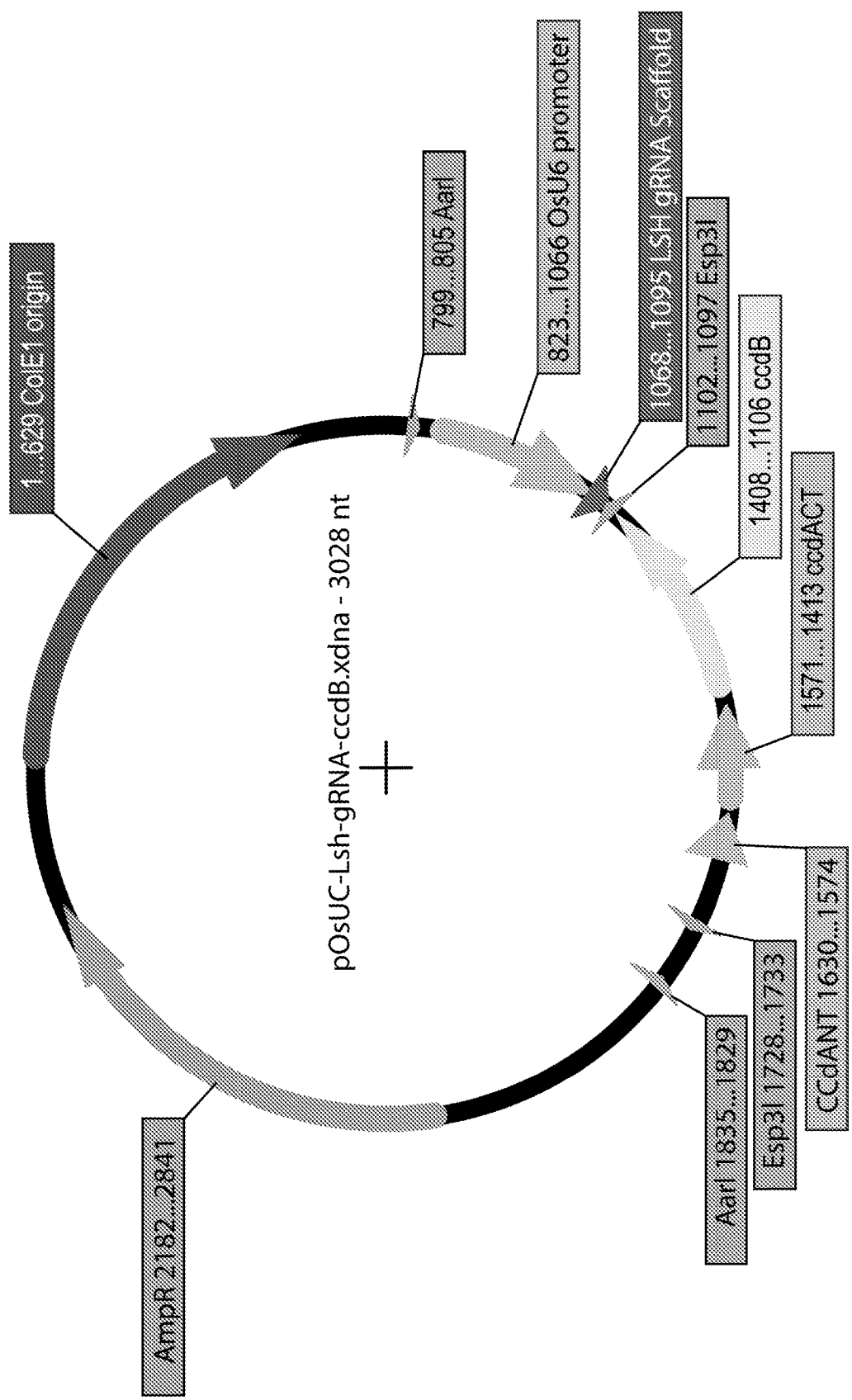

Before the present invention is described in detail below, it is to be understood that this invention is not limited to the particular methodology, protocols and reagents described herein, as these may vary. It is also to be understood that the terminology used herein is for the purpose of describing particular embodiments only, and is not intended to limit the scope of the present invention which will be limited only by the appended claims. Unless defined otherwise, all technical and scientific terms used herein have the same meanings as commonly understood by one of ordinary skill in the art.

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, $2^{nd}$ edition (1989) (Sambrook, Fritsch, and Maniatis); Molecular Cloning: A Laboratory Manual, $4^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratroy Manual (1988) (Harlow and Lane, eds.): Antibodies, A Laboratory Manual, $2^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994); March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, $2^{nd}$ edition (2011)

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

The terms "therapeutic agent", "therapeutic capable agent" or "treatment agent" are used interchangeably and refer to a molecule or compound that confers some beneficial effect upon administration to an organism, tissue, or cell. The beneficial effect includes enablement of diagnostic determinations; amelioration of a disease, symptom, disorder, or pathological condition; reducing or preventing the onset of a disease, symptom, disorder or condition; and generally counteracting a disease, symptom, disorder or pathological condition.

As used herein, "treatment" or "treating," or "palliating" or "ameliorating" are used interchangeably. These terms refer to an approach for obtaining beneficial or desired results including, but not limited to, a therapeutic benefit and/or a prophylactic benefit. By therapeutic benefit is meant any therapeutically relevant improvement in or effect on one or more diseases, conditions, or symptoms under treatment. For prophylactic benefit, the compositions may be administered to a plant at risk of developing a particular disease, condition, or symptom, or to a plant reporting one or more of the symptoms of a disease, even though the disease, condition, or symptom may not have yet been manifested.

The term "effective amount" or "therapeutically effective amount" refers to the amount of an agent that is sufficient to effect beneficial or desired results. The therapeutically effective amount may vary depending upon one or more of: the plant and disease condition being treated, the severity of the disease condition, the manner of administration and the like, which can readily be determined by one of ordinary skill in the art. The term also applies to a dose that will provide an image for detection by any one of the imaging methods described herein. The specific dose may vary depending on one or more of: the particular agent chosen, the dosing regimen to be followed, whether it is administered in combination with other compounds, timing of administration, the tissue to be imaged, and the physical delivery system in which it is carried.

All publications, published patent documents, and patent applications cited in this application are indicative of the level of skill in the art(s) to which the application pertains. All publications, published patent documents, and patent applications cited herein are hereby incorporated by reference to the same extent as though each individual publication, published patent document, or patent application was specifically and individually indicated as being incorporated by reference.

Overview

In general, a CRISPR-Cas or CRISPR system as used in the foregoing documents, such as WO 2014/093622 (PCT/US2013/074667), refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas, such as Cas9, e.g. CRISPR RNA (crRNA) and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). When the CRISPR protein is a C2c2 protein, a tracrRNA is not required.

In some embodiments, direct repeats may be identified in silico by searching for repetitive motifs that fulfill any or all of the following criteria: 1. found in a 2Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise RNA polynucleotides. The term "target RNA" refers to a RNA polynucleotide being or comprising the target sequence. In other words, the target RNA may be a RNA polynucleotide or a part of a RNA polynucleotide to which a part of the gRNA, i.e. the guide sequence, is designed to have complementarity and to which the effector function mediated by the complex comprising CRISPR effector protein, preferably C2c2, and a gRNA is to be directed. In some embodiments, a target sequence is located in the nucleus or cytoplasm of a cell.

In some embodiments, the target RNA is the genome of an RNA virus, preferably of a ssRNA virus, or a subsection thereof. As used herein, the term "RNA virus" refers to a virus that has RNA (ribonucleic acid) as its genetic material independently of whether its life cycle encompasses DNA intermediates. In other embodiments, the target RNA is a transcript of the genome of a virus, for example, of a DNA virus, or a subsection thereof. Preferably, the virus is a plant virus. In other embodiments, the target RNA is an mRNA. In a preferred embodiment, the target RNA is a plant mRNA.

As used herein, the term "crRNA" or "guide RNA" or "single guide RNA" or "sgRNA" or "one or more nucleic acid components" refers to a polynucleotide comprising any polynucleotide sequence having sufficient complementarity with a target nucleic acid sequence to hybridize with the target nucleic acid sequence and to direct sequence-specific binding of a RNA-targeting complex comprising the gRNA and a CRISPR effector protein, preferably C2c2, to the target nucleic acid sequence. In general, a gRNA may be any polynucleotide sequence (i) being able to form a complex with a CRISPR effector protein and (ii) comprising a sequence having sufficient complementarity with a target polynucleotide sequence to hybridize with the target sequence and direct sequence-specific binding of a CRISPR complex to the target sequence. As used herein, the term "capable of forming a complex with the CRISPR effector protein" refers to the gRNA having a structure that allows specific binding by the CRISPR effector protein to the gRNA such that a complex is formed that is capable of binding to a target RNA in a sequence specific manner and that can exert a function on said target RNA. Structural components of the gRNA may include direct repeats and a guide sequence (or spacer). The sequence specific binding to the target RNA is mediated by a part of the gRNA, the "guide sequence", being complementary to the target RNA. In embodiments of the invention, the term guide RNA, i.e. RNA capable of guiding Cas to a target locus, is used as in foregoing cited documents such as WO 2014/093622 (PCT/US2013/074667). As used herein, the term "wherein the guide sequence is capable of hybridizing" refers to a sub-section of the gRNA having sufficient complementarity to the target sequence to hybridize thereto and to mediate binding of a CRISPR complex to the target RNA. In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting examples of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably, the guide sequence is 10 to 30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target RNA may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

In classic CRISPR-Cas systems, the degree of complementarity between a guide sequence and its corresponding target sequence can be about or more than about 50%, 60%, 75%, 80%, 85%, 90%, 95%, 97.5%, 99%, or 100%; a guide sequence or guide RNA or sgRNA can be about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length; or guide sequence or guide RNA or sgRNA can be less than about 75, 50, 45, 40, 35, 30, 25, 20, 15, 12, or fewer nucleotides in length. However, an aspect of the invention is to reduce off-target interactions, e.g., reduce the guide interacting with a target sequence having low complementarity. The invention involves mutations that result in the CRISPR-Cas system being able to distinguish between target and off-target sequences that have greater than 80% to about 95% complementarity, e.g., 83%-84% or 88-89% or 94-95% complementarity (for instance, distinguishing between a target having 18 nucleotides from an off-target of 18 nucleotides having 1, 2 or 3 mismatches). Accordingly, in the context of the present invention, the degree of complementarity between a guide sequence and its corresponding target sequence is greater than 94.5% or 95% or 95.5% or 96% or 96.5% or 97% or 97.5% or 98% or 98.5% or 99% or 99.5% or 99.9%. Preferably, in the context of the present invention the degree of complementarity between a guide sequence and its corresponding target sequence is 100%. Off target is less than 100% or 99.9% or 99.5% or 99% or 98.5% or 98% or 97.5% or 97% or 96.5% or 96% or 95.5% or 95% or 94.5% or 94% or 93% or 92% or 91% or 90% or 89% or 88% or 87% or 86% or 85% or 84% or 83% or 82% or 81% or 80% complementarity between the target sequence and the guide, with it being advantageous that off target is 99.9% or 99.5% or 99% or 98.5% or 98% or 97.5% or 97% or 96.5% or 96% or 95.5% or 95% or 94.5% complementarity between the target sequence and the guide.

In certain embodiments, modulations of cleavage efficiency can be exploited by introduction of mismatches, e.g., 1 or more mismatches, such as 1 or 2 mismatches between spacer sequence and target sequence, including the position of the mismatch along the spacer/target. The more central (i.e. not 3' or 5') for instance a double mismatch is, the more cleavage efficiency is affected. Accordingly, by choosing mismatch position along the spacer, cleavage efficiency can be modulated. By means of example, if less than 100% cleavage of targets is desired (e.g. in a cell population), 1 or more, such as preferably 2 mismatches between spacer and target sequence may be introduced in the spacer sequences. The more central along the spacer of the mismatch position, the lower the cleavage percentage.

For minimization of toxicity and off-target effect, it will be important to control the concentration of Cas mRNA or protein and guide RNA delivered. Optimal concentrations of Cas mRNA or protein and guide RNA can be determined by testing different concentrations in a cellular or plant model and using deep sequencing to analyze the extent of modification at potential off-target sequences.

Typically, in the context of an endogenous CRISPR system, formation of a CRISPR complex (comprising a guide sequence hybridized to a target sequence and complexed with one or more Cas proteins) results in cleavage in or near (e.g. within 1, 2, 3, 4, 5, 6, 7, 8, 9, 10, 20, 50, or more base pairs from) the target sequence, but may depend on for instance secondary structure, in particular in the case of RNA targets.

The nucleic acid molecule encoding a CRISPR effector protein, in particular C2c2, is advantageously codon optimized. An example of a codon optimized sequence is, in this instance, a sequence optimized for expression in a plant. Codon optimization for a host plant is known. In some embodiments, an enzyme coding sequence encoding a Cas is codon optimized for expression in particular cells, such as eukaryotic cells. The eukaryotic cells may be those of or derived from a particular organism, such as a plant. In a preferred embodiment, the cell is a plant cell. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a Cas correspond to the most frequently used codon for a particular amino acid. For example, codon optimization in plants can be done using methods known in the art. Plant codon usage is known, for example, from E Murray et al., Nucleic Acids Res. 1989 Jan. 25; 17(2): 477-498. Further guidance is found also in the article by S. Kumar et al., "Plant codon optimized cry genes of *Bacillus thuringiensis* can be expressed as soluble proteins in *Escherichia coli* BL21 Codon Plus strain as NusA-Cry protein fusions", Journal of Invertebrate Pathology, Volume 88, Issue 1, January 2005, Pages 83-86.

In certain embodiments, the methods as described herein may comprise providing a Cas transgenic cell, in particular a C2c2 transgenic cell, in which one or more nucleic acids encoding one or more guide RNAs are provided or introduced operably connected in the cell with a regulatory element comprising a promoter of one or more gene of interest. In a preferred embodiment, the polynucleotide encoding the CRISPR effector protein and/or the polynucleotide comprising or encoding the nucleic acid components are operably connected with a regulatory element comprising the promoter of a gene known to be upregulated in a plant cell upon infection with a pathogen. For example, regulatory element to which the polynucleotide encoding the CRISPR effector protein and/or the polynucleotide comprising or encoding the nucleic acid components are operably connected may comprise a promoter of a resistance gene that is upregulated in the presence of the plant pathogen that comprises the target RNA, i.e. the RNA to which the guide sequence is complementary. As used herein, the term "Cas transgenic cell" refers to a cell, such as a eukaryotic cell, in which a Cas gene has been genomically integrated. The nature, type, or origin of the cell are not particularly limiting according to the present invention. It is, however, preferred that the cell is a plant cell. Also, how the Cas transgene is introduced in the cell may vary and can be any method as is known in the art. In certain embodiments, the Cas transgenic cell is obtained by introducing the Cas transgene in an isolated cell. In certain other embodiments, the Cas transgenic cell is obtained by introducing the Cas transgene into at least one cell of an organism, preferably a plant. In certain other embodiments, the Cas transgenic cell is obtained by isolating cells from a Cas transgenic organism. By means of example, and without limitation, the Cas transgenic cell as referred to herein may be derived from a Cas transgenic eukaryote, such as a Cas knock-in eukaryote. Reference is made to WO 2014/093622 (PCT/US13/74667), incorporated herein by reference. Methods of US Patent Publication Nos. 20120017290 and 20110265198 assigned to Sangamo BioSciences, Inc. directed to targeting the Rosa locus may be modified to utilize the CRISPR Cas system of the present invention. Methods of US Patent Publication No. 20130236946 assigned to Cellectis directed to targeting the Rosa locus may also be modified to utilize the CRISPR Cas system of the present invention. The Cas transgene can further comprise a Lox-Stop-polyA-Lox(LSL) cassette thereby rendering Cas expression inducible by Cre recombinase. Alternatively, the Cas transgenic cell may be obtained by introducing the Cas transgene in an isolated cell. Delivery systems for transgenes are well known in the art. As used herein, the term "delivery system" refers to a means for transporting the (non-naturally occurring or engineered) system of the invention, the polynucleotide of the invention, the vector of the invention and/or the vector system of the invention into a plant or plant cell. A delivery system, may for example be a virus, a particle or a bacterium such as *Agrobacterium tumefaciens* comprising the (non-naturally occurring or engineered) system of the invention, the polynucleotide of the invention, the vector of the invention and/or the vector system of the invention or components thereof. By means of example, the Cas transgene may be delivered into for instance a plant cell by means of *Agrobacterium tumefaciens* comprising for example an *Agrobacterium* vector (e.g. based off pCAMBIA) encoding the CRISPR effector protein and/or particle and/or nanoparticle delivery, as also described herein elsewhere.

It will be understood by the skilled person that the cell, such as the Cas transgenic cell, as referred to herein, may comprise further genomic alterations besides having an integrated Cas gene.

In some embodiments, the Cas sequence, in particular the C2c2 sequence, is fused to one or more nuclear localization sequences (NLSs) or nuclear export signals (NESs), such as about or more than about 1, 2, 3, 4, 5, 6, 7, 8, 9, 10, or more NLSs or NESs. In some embodiments, the Cas sequence comprises about or more than about 1, 2, 3, 4, 5, 6, 7, 8, 9, 10, or more NLSs or NESs at or near the amino-terminus, about or more than about 1, 2, 3, 4, 5, 6, 7, 8, 9, 10, or more NLSs or NESs at or near the carboxy-terminus, or a combination of these (e.g. zero or at least one or more NLS or NES at the amino-terminus and zero or at one or more NLS or NES at the carboxy terminus). When more than one NLS or NES is present, each may be selected independently of the others, such that a single NLS or NES may be present in more than one copy and/or in combination with one or more other NLSs or NESs present in one or more copies. In a preferred embodiment of the invention, the Cas comprises at most 6 NLSs. In some embodiments, an NLS or NES is considered near the N- or C-terminus when the nearest amino acid of the NLS or NES is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 27); the NLS from nucleoplasmin (e.g. the nucleoplasmin bipartite NLS with the sequence KRPAATKKAGQAKKKK) (SEQ ID NO: 28); the c-myc NLS having the amino acid sequence PAAKRVKLD (SEQ ID NO: 29) or RQRRNELKRSP (SEQ ID NO: 30); the hRNPA1 M9 NLS having the sequence NQSSNFGPMKGGNFGGRSSGPYGGGGQYFAK-PRNQGGY (SEQ ID NO: 31); the sequence RMRIZFKNKGKDTAELRRRRVEVSVELRKAKKD-EQILKRRNV (SEQ ID NO: 32) of the IBB domain from importin-alpha; the sequences VSRKRPRP (SEQ ID NO: 33) and PPKKARED (SEQ ID NO: 34) of the myoma T protein; the sequence PQPKKKPL (SEQ ID NO: 35) of human p53; the sequence SALIKKKKKMAP (SEQ ID NO: 36) of mouse c-abl IV; the sequences DRLRR (SEQ ID NO: 37) and PKQKKRK (SEQ ID NO: 38) of the influenza virus NS1; the sequence RKLKKKIKKL (SEQ ID NO: 39) of the Hepatitis virus delta antigen; the sequence REKKKFLKRR (SEQ ID NO: 40) of the mouse Mx1 protein; the sequence KRKGDEVDGVDEVAKKKSKK (SEQ ID NO: 41) of the human poly(ADP-ribose) polymerase; and the sequence RKCLQAGMNLEARKTKK (SEQ ID NO: 42) of the steroid hormone receptors (human) glucocorticoid. Non-limiting examples of NESs include an NES sequence LYPER-LRRILT (SEQ ID NO: 16) (ctgtaccctgagcggctgcggcggatcctgacc) (SEQ ID NO: 43). In general, the one or more NLSs or NESs are of sufficient strength to drive accumulation of the Cas in a detectable amount in, respectively, the nucleus or the cytoplasm of a eukaryotic cell. In general, strength of nuclear localization/export activity may derive from the number of NLSs/NESs in the Cas, the particular NLS(s) or NES(s) used, or a combination of these factors. Detection of accumulation in the nucleus/cytoplasm may be performed by any suitable technique. For example, a detectable marker may be fused to the Cas, such that location within a cell may be visualized, such as in combination with a means for detecting the location of the nucleus (e.g. a stain specific for the nucleus such as DAPI) or cytoplasm. Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or Cas enzyme activity), as compared to a control not exposed to the Cas or complex, or exposed to a Cas lacking the one or more NLSs or NESs. In certain embodiments, other localization tags may be fused to the Cas protein, such as without limitation for localizing the Cas to particular sites in a cell, such as organelles, such mitochondria, plastids, chloroplasts, vesicles, golgi, (nuclear or cellular) membranes, ribosomes, nucleoluse, ER, cytoskeleton, vacuoles, centrosomes, nucleosomes, granules, centrioles, etc.

In certain aspects, the invention involves vectors, e.g. for delivering or introducing in a cell Cas and/or RNA capable of guiding Cas to a target locus (i.e. guide RNA), but also for propagating these components (e.g. in prokaryotic cells). In particular, the invention relates to a vector comprising a polynucleotide comprising or encoding a polynucleotide encoding a CRISPR effector protein and a polynucleotide comprising or encoding the nucleic acid component(s) of a CRISPR system. As used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. geminiviral vectors or vectors based on tobacco mosaic virus (TMV), potato virus X (PVX), alfalfa mosaic virus (AMV) and cucumber mosaic virus (CMV)). In addition, infectious cDNA clones of positive-strand RNA viruses may be used. In a preferred embodiment, vectors for expressing the CRISPR effector protein and the gRNA, for example as described in the Examples, can be combined via golden gate cloning and put into *Agrobacterium* vectors (based off pCAMBIA) for whole plant transformation or basic expression vectors for protoplasts. Viral vectors also include polynucleotides carried by a virus for transfection into a host cell. Certain vectors are capable of autonomous replication in a host cell into which they are introduced (e.g. bacterial vectors having a bacterial origin of replication). Other vectors are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

The vector(s) can include the regulatory element(s), e.g., promoter(s). The vector(s) can comprise Cas encoding sequences, and/or a single, but possibly also can comprise at least 3 or 8 or 16 or 32 or 48 or 50 guide RNA(s) (e.g., gRNAs) encoding sequences, such as 1-2, 1-3, 1-4 1-5, 3-6, 3-7, 3-8, 3-9, 3-10, 3-14 3-16, 3-30, 3-32, 3-48, 3-50 RNA(s) (e.g., gRNAs). In a single vector there can be a promoter for each RNA (e.g., gRNA), advantageously when there are up to about 16 RNA(s); and, when a single vector provides for more than 16 RNA(s), one or more promoter(s) can drive expression of more than one of the RNA(s), e.g., when there are 32 RNA(s), each promoter can drive expression of two RNA(s), and when there are 48 RNA(s), each promoter can drive expression of three RNA(s). By simple arithmetic and well established cloning protocols and the teachings in this disclosure, one skilled in the art can readily practice the invention as to the RNA(s) for a suitable exemplary vector, and a suitable promoter. The length of a single U6-gRNA (plus restriction sites for cloning) is 361 bp. Multiple U6-gRNA cassettes can be fitted in a single vector. This can be assembled by any suitable means, such as a golden gate strategy used for TALE assembly (http://www.genome-engineering.org/taleffectors/). The skilled person can also use a tandem guide strategy to increase the number of U6-gRNAs by approximately 1.5 times. A further means for increasing the number of promoters and RNAs in a vector is to use a single promoter (e.g., U6) to express an array of RNAs separated by cleavable sequences. An even further means for increasing the number of promoter-RNAs in a vector is to express an array of promoter-RNAs separated by cleavable sequences in the intron of a coding sequence or gene; and, in this instance it is advantageous to use a polymerase II promoter, which can have increased expression and enable the transcription of long RNA in a tissue specific manner. (See, e.g., http://nar.oxfordjournals.org/content/34/7/e53.short, http://www.nature.com/mt/journal/v16/n9/abs/mt2008144a.html). In an advantageous embodiment, a vector may package U6 tandem gRNA targeting up to about 50 targets. Accordingly, from the knowledge in the art and the teachings in this disclosure, the skilled person can readily make and use vector(s), e.g., a single vector, expressing multiple RNAs or guides under the control or operatively or functionally linked to one or more promoters—especially as to the numbers of RNAs or guides discussed herein, without any undue experimentation.

The guide RNA(s) encoding sequences and/or Cas encoding sequences, can be functionally or operatively linked to regulatory element(s) and hence the regulatory element(s) drive expression. The promoter(s) can be constitutive promoter(s) and/or conditional promoter(s) and/or inducible promoter(s) and/or tissue specific promoter(s). The promoter can be selected from the group consisting of RNA polymerases, pol I, pol II, pol III, T7, U6, H1, retroviral Rous sarcoma virus (RSV) LTR promoter, the cytomegalovirus (CMV) promoter, the SV40 promoter, the dihydrofolate reductase promoter, the β-actin promoter, the phosphoglycerol kinase (PGK) promoter, and the EF1α promoter. Suitable plant promoters are known in the art and include, for example, the Cauliflower Mosaic Virus CaMV35S promoter and the maize ubiquitin gene Ubi promoter. Advantageous promotors include the rice U6 promoter for monocots and the *arabidopsis* U6 promoter for dicots, including the U6-26 promoter.

The term "nucleic acid-targeting system", wherein nucleic acid is RNA, refers collectively to transcripts and other elements involved in the expression of or directing the activity of RNA-targeting CRISPR-associated ("Cas") genes, which may include sequences encoding a RNA-targeting Cas protein and a RNA-targeting guide RNA comprising a CRISPR RNA (crRNA) sequence and (in some but not all systems) a trans-activating CRISPR/Cas system RNA (tracrRNA) sequence, or other sequences and transcripts from a RNA-targeting CRISPR locus. In general, a RNA-targeting system is characterized by elements that promote the formation of a RNA-targeting complex at the site of a target RNA sequence. In the context of formation of a RNA-targeting complex, "target sequence" refers to a RNA sequence to which a RNA-targeting guide RNA is designed to have complementarity, where hybridization between a target sequence and a RNA-targeting guide RNA promotes the formation of a RNA-targeting complex. In some embodiments, a target sequence is located in the nucleus or cytoplasm of a cell. In the case of C2c2, the targeted nucleic acid is RNA, and the nucleic acid targeting system may not involve or require a tracrRNA.

In an aspect of the invention, novel RNA targeting systems also referred to as RNA- or RNA-targeting CRISPR/Cas or the CRISPR-Cas system RNA-targeting system of the present application are based on identified C2c2 proteins which do not require the generation of customized proteins to target specific RNA sequences but rather a single enzyme can be programmed by a RNA molecule to recognize a specific RNA target. In other words, the enzyme can be recruited to a specific RNA target using said RNA molecule.

The nucleic acids-targeting systems, the vector systems, the vectors and the compositions described herein may be used in various nucleic acids-targeting applications, altering or modifying synthesis of a gene product, such as a protein, nucleic acids cleavage, nucleic acids editing, nucleic acids splicing, trafficking of target nucleic acids, tracing of target nucleic acids, isolation of target nucleic acids, visualization of target nucleic acids, etc. In particular, the CRISPR systems, polynucleotides, vectors and vector systems of the invention can be used to cleave target RNAs or to alter their translation such that the resistance of a plant cell or plant to a plant pathogen is created or enhanced.

C2c2 Nuclease

As mentioned previously, C2c2 is also known as "Cas13a". The activity of C2c2 depends on the presence of two HEPN domains. These have been shown to be RNase domains, i.e. nuclease (in particular an endonuclease) cutting RNA. C2c2 HEPN may also target DNA, or potentially DNA and/or RNA. On the basis that the HEPN domains of C2c2 are at least capable of binding to and, in their wild-type form, cutting RNA, then it is preferred that the C2c2 effector protein has RNase function. Regarding C2c2 CRISPR Systems reference is made to U.S. Provisional 62/351,662, filed on Jun. 17, 2016, U.S. Provisional 62/376,377, filed on Aug. 17, 2016, and U.S. Provisional 62/410,366, filed Oct. 19, 2016. Reference is also made to U.S. Provisional 62/351,803, filed on Jun. 17, 2016, and U.S. Provisional 62/432,240 entitled "Novel Crispr Enzymes and Systems" filed Dec. 9, 2016.

Thus, in some embodiments, the effector protein may be a RNA-binding protein, such as a dead-Cas type effector protein, which may be optionally functionalized as described herein for instance with a translational activator or repressor domain, NLS, NES or other functional domain, such as other subcellular localization domains. In some embodiments, the effector protein may be a RNA-binding protein that cleaves a single strand of RNA. If the RNA bound is ssRNA, then the ssRNA is fully cleaved. In some embodiments, the effector protein may be a RNA-binding protein that cleaves a double strand of RNA, for example, if it comprises two RNase domains. If the RNA bound is dsRNA, then the dsRNA is fully cleaved.

RNase function in CRISPR systems is known, for example, mRNA targeting has been reported for certain type III CRISPR-Cas systems (Hale et al., 2014, Genes Dev, vol. 28, 2432-2443; Hale et al., 2009, Cell, vol. 139, 945-956; Peng et al., 2015, Nucleic acids research, vol. 43, 406-417) and provides significant advantages. In the *Staphylococcus epidermis* type III-A system, transcription across targets results in cleavage of the target DNA and its transcripts, mediated by independent active sites within the Cas10-Csm ribonucleoprotein effector complex (see, Samai et al., 2015, Cell, vol. 151, 1164-1174). A CRISPR-Cas system, composition or method targeting RNA via the present effector proteins is thus provided.

The target RNA, i.e. the RNA of interest, is the RNA to be targeted by the present invention leading to the recruitment to, and the binding of the effector protein at, the target site of interest on the target RNA. The target RNA may be any suitable form of RNA. This may include, in some embodiments, mRNA. In other embodiments, the target RNA may include tRNA or rRNA. In other embodiments, the target RNA may include miRNA. In other embodiments, the target RNA may include siRNA.

Interfering RNA (RNAi) and microRNA (miRNA)

In other embodiments, the target RNA may include interfering RNA, i.e. RNA involved in an RNA interference pathway, such as shRNA, siRNA and so forth, both in eukaryotes and prokaryotes. In other embodiments, the target RNA may include microRNA (miRNA). Control over interfering RNA or miRNA may help reduce off-target effects (OTE) seen with those approaches by reducing the longevity of the interfering RNA or miRNA in vivo or in vitro.

In certain embodiments, the target is not the miRNA itself, but the miRNA binding site of a miRNA target.

In certain embodiments, miRNAs may be sequestered (such as, including subcellularly relocated). In certain embodiments, miRNAs may be cut, such as, without limitation at hairpins.

In certain embodiments, miRNA processing (such as including turnover) is increased or decreased.

If the effector protein and suitable guide are selectively expressed (for example spatially or temporally under the control of a suitable promoter, for example a tissue- or cell cycle-specific promoter and/or enhancer) then this could be used to 'protect' the cells or systems (in vivo or in vitro) from RNAi in those cells. This may be useful in neighbouring tissues or cells where RNAi is not required or for the purposes of comparison of the cells or tissues where the effector protein and suitable guide are and are not expressed (i.e. where the RNAi is not controlled and where it is, respectively). The effector protein may be used to control or bind to molecules comprising or consisting of RNA, such as ribozymes, ribosomes or riboswitches. In embodiments of the invention, the RNA guide can recruit the effector protein to these molecules so that the effector protein is able to bind to them.

The protein system of the invention can be applied in areas of RNAi technologies, without undue experimentation, from this disclosure, including therapeutic, assay and other applications (see, e.g., Guidi et al., PLoS Negl Trop Dis 9(5): e0003801. doi:10.1371/journal.pntd; Crotty et al., In vivo RNAi screens: concepts and applications. Shane Crotty 2015 Elsevier Ltd. Published by Elsevier Inc., Pesticide Biochemistry and Physiology (Impact Factor: 2.01). January 2015; 120. DOI: 10.1016/j.pestbp.2015.01.002; and Makkonen et al., Viruses 2015, 7(4), 2099-2125; doi: 10.3390/v7042099), because the present application provides the foundation for informed engineering of the system.

Ribosomal RNA (rRNA)

For example, azalide antibiotics such as azithromycin, are well known. They target and disrupt the 50S ribosomal subunit. The present effector protein, together with a suitable guide RNA to target the 50S ribosomal subunit, may be, in some embodiments, recruited to and bind to the 50S ribosomal subunit. Thus, the present effector protein in concert with a suitable guide directed at a ribosomal (especially the 50s ribosomal subunit) target is provided. Use of this use effector protein in concert with the suitable guide directed at the ribosomal (especially the 50s ribosomal subunit) target may include antibiotic use. In particular, the antibiotic use is analogous to the action of azalide antibiotics, such as azithromycin. In some embodiments, prokaryotic ribosomal subunits, such as the 70S subunit in prokaryotes, the 50S subunit mentioned above, the 30S subunit, as well as the 16S and 5S subunits may be targeted. In other embodiments, eukaryotic ribosomal subunits, such as the 80S subunit in eukaryotes, the 60S subunit, the 40S subunit, as well as the 28S, 18S. 5.8S and 5S subunits may be targeted.

In some embodiments, the effector protein may be a RNA-binding protein, optionally functionalized, as described herein. In some embodiments, the effector protein may be a RNA-binding protein that cleaves a single strand of RNA. In either case, but particularly where the RNA-binding protein cleaves a single strand of RNA, then ribosomal function may be modulated and, in particular, reduced or destroyed. This may apply to any ribosomal RNA and any ribosomal subunit and the sequences of rRNA are well known.

Control of ribosomal activity is thus envisaged through use of the present effector protein in concert with a suitable guide to the ribosomal target. This may be through cleavage of, or binding to, the ribosome.

Riboswitches

A riboswitch (also known as an aptozyme) is a regulatory segment of a messenger RNA molecule that binds a small molecule. This typically results in a change in production of the proteins encoded by the mRNA. Thus, control of riboswitch activity is thus envisaged through use of the present effector protein in concert with a suitable guide to the riboswitch target. This may be through cleavage of, or binding to, the riboswitch. In particular, reduction of riboswitch activity is envisaged.

Ribozymes

Ribozymes are RNA molecules having catalytic properties, analogous to enzymes (which are of course proteins). As ribozymes, both naturally occurring and engineered, comprise or consist of RNA, they may also be targeted by the present RNA-binding effector protein. In some embodiments, the effector protein may be a RNA-binding protein that cleaves the ribozyme to thereby disable it. Control of ribozymal activity is thus envisaged through use of the present effector protein in concert with a suitable guide to the ribozymal target. This may be through cleavage of, or binding to, the ribozyme. In particular, reduction of ribozymal activity is envisaged Gene Expression, Including RNA Processing The effector protein may also be used, together with a suitable guide, to target gene expression, including via control of RNA processing. The control of RNA processing may include RNA processing reactions such as RNA splicing, including alternative splicing, via targeting of RNApol; viral replication (in particular of viruses pathogenic to plants) including in particular replication of viruses and virioids in plants; and tRNA biosynthesis. The effector protein and suitable guide may also be used to control RNAactivation (RNAa). RNAa leads to the promotion of gene expression, so control of gene expression may be achieved that way through disruption or reduction of RNAa and thus less promotion of gene expression. This is discussed more in detail below.

RNAi Screens

By identifying gene products whose knockdown is associated with phenotypic changes, biological pathways can be interrogated and the constituent parts identified, via RNAi screens. Control may also be exerted over or during these screens by use of the effector protein and suitable guide to remove or reduce the activity of the RNAi in the screen and thus reinstate the activity of the (previously interfered with) gene product (by removing or reducing the interference/repression).

Satellite RNAs (satRNAs) and satellite viruses may also be treated.

Control herein with reference to RNase activity generally means reduction, negative disruption or known-down or knock out.

In Vivo RNA Applications

Inhibition of Gene Expression

The target-specific RNAses provided herein allow for very specific cutting of a target RNA. The interference at RNA level allows for modulation both spatially and temporally and in a non-invasive way, as the genome is not modified.

A number of diseases have been demonstrated to be treatable by mRNA targeting. While most of these studies relate to administration of siRNA, it is clear that the RNA targeting effector proteins provided herein can be applied in a similar way.

Examples of RNAs that can be targeted in plants include the genome of RNA viruses as well as RNA intermediates of DNA viruses. Examples of mRNA targets in plants include mRNAs encoded by a susceptibility gene. These mRNAs may be targeted and cut. This may decrease or abolish compatibility with a plant pathogen. For example, translation initiation like factors eIF4E and eIF(iso)4E have been shown to be required for viral survival of Turnip mosaic virus (TuMV) in *Arabidopsis thaliana* and disrupting such a factor led to partial resistance to Cumcumber vein yellowing virus, Zucchini yellow mosaic virus and *papaya* ring spot mosaic virus-W in cucumber. Thus, these factors are examples of mRNAs that can be targeted in order to confer resistance against plant viruses. In addition, for example, targeting the mRNAs of Mildew-resistance locus (MLO) proteins may confer or increase resistance to powdery mildew (Wang et al., Nature Biotechnology, 2014). Similarly, targeting the mRNA of the ERF transcription factor gene OSERF922 (Wang et al., Plos One, 2016) may confer or enhance resistance, to fungi such as *Magnaporthe grisea* thereby generating or improving resistance to rice blast. Examples of plant mRNAs that may be targeted in metabolic engineering include, for example, the alcohol dehydrogenase mRNA encoding an enzyme that catalyzes the conversion of allyl alcohol into the toxic compound acrolein. Also, mRNAs encoding proteins involved in enzymatic browning such as polyphenol oxidase (PPO) (Holderbaum, HortScience 2010) may be targeted, for example in apples, thus reducing or preventing enzymatic browning and the associated negative effects on color, taste, flavor and nutritional value of the affected fruits and vegetables.

It is further envisaged that the RNA targeting effector protein of the invention can be used for mutation specific or allele specific knockdown. Guide RNAs can be designed that specifically target a sequence in the transcribed mRNA comprising a mutation or an allele-specific sequence. Such specific knockdown is particularly suitable for therapeutic applications relating to disorders associated with mutated or allele-specific gene products. For example, most cases of familial hypobetalipoproteinemia (FHBL) are caused by mutations in the ApoB gene. This gene encodes two versions of the apolipoprotein B protein: a short version (ApoB-48) and a longer version (ApoB-100). Several ApoB gene mutations that lead to FHBL cause both versions of ApoB to be abnormally short. Specifically targeting and knockdown of mutated ApoB mRNA transcripts with an RNA targeting effector protein of the invention may be beneficial in treatment of FHBL. As another example, Huntington's disease (HD) is caused by an expansion of CAG triplet repeats in the gene coding for the Huntingtin protein, which results in an abnormal protein. Specifically targeting and knockdown of mutated or allele-specific mRNA transcripts encoding the Huntingtin protein with an RNA targeting effector protein of the invention may be beneficial in treatment of HD. Similar approaches may also be taken in plant diseases caused by or associated with mutated or allele-specific gene products.

It is noted that in this context, and more generally for the various applications as described herein, the use of a split version of the RNA targeting effector protein can be envisaged. Indeed, this may not only allow increased specificity but may also be advantageous for delivery. The CRISPR effector protein is split in the sense that the two parts of the CRISPR effector protein substantially comprise a functioning CRISPR effector, such as for example a functioning C2c2. Ideally, the split should always be so that the catalytic domain(s) are unaffected. That CRISPR effector protein may function as a nuclease or it may be a dead-CRISPR effector protein which is essentially an RNA-binding protein with very little or no catalytic activity, due to typically mutation(s) in its catalytic domains.

Each half of the split CRISPR effector protein may be fused to a dimerization partner. By means of example, and without limitation, employing rapamycin sensitive dimerization domains, allows to generate a chemically inducible split CRISPR effector protein for temporal control of CRISPR effector protein activity. The CRISPR effector protein can thus be rendered chemically inducible by being split into two fragments and that rapamycin-sensitive dimerization domains may be used for controlled reassembly of the CRISPR effector protein. The two parts of the split CRISPR effector protein can be thought of as the N' terminal part and the C' terminal part of the split CRISPR effector protein. The fusion is typically at the split point of the CRISPR effector protein. In other words, the C' terminal of the N' terminal part of the split CRISPR effector protein is fused to one of the dimer halves, whilst the N' terminal of the C' terminal part is fused to the other dimer half.

The CRISPR effector protein does not have to be split in the sense that the break is newly created. The split point is typically designed in silico and cloned into the constructs. Together, the two parts of the split CRISPR effector protein, the N' terminal and C' terminal parts, form a full CRISPR effector protein, comprising preferably at least 70% or more of the wildtype amino acids (or nucleotides encoding them), preferably at least 80% or more, preferably at least 90% or more, preferably at least 95% or more, and most preferably at least 99% or more of the wildtype amino acids (or nucleotides encoding them). Some trimming may be possible, and mutants are envisaged. Non-functional domains may be removed entirely. What is important is that the two parts may be brought together and that the desired CRISPR effector protein function is restored or reconstituted. The dimer may be a homodimer or a heterodimer.

In certain embodiments, the CRISPR effector protein effector as described herein may be used for mutation-specific, or allele-specific targeting, such as for mutation-specific, or allele-specific knockdown.

The RNA targeting effector protein can moreover be fused to another functional RNAse domain, such as a non-specific RNase or Argonaute 2, which acts in synergy to increase the RNAse activity or to ensure further degradation of the target.
Modulation of Gene Expression Through Modulation of RNA Function Apart from a direct effect on gene expression through cleavage of the mRNA, RNA targeting can also be used to impact specific aspects of the RNA processing within the cell, which may allow a more subtle modulation of gene expression. Generally, modulation can for instance be mediated by interfering with binding of proteins to the RNA, such as for instance blocking binding of proteins, or recruiting RNA binding proteins. Indeed, modulations can be ensured at different levels such as splicing, transport, localization, translation and turnover of the target RNA. Similarly, it can be envisaged to address (pathogenic) malfunctioning at each of these levels by using RNA-specific targeting molecules. In these embodiments, it is in many cases preferred that the RNA targeting protein is a "dead" CRISPR effector protein that has lost the ability to cut the RNA target but maintains its ability to bind thereto, such as the mutated forms of C2c2 described herein.

A) Alternative Splicing

Many of the plant genes express multiple mRNAs as a result of alternative splicing and this process plays a role in a range of physiological processes, including plant disease resistance. Many plant disease resistance (R) genes undergo alternative splicing and several resistance genes require alternatively spliced transcripts to produce R proteins that can specifically recognize pathogen invasion. One option is to target the splicing mechanism directly. The RNA targeting effector proteins described herein can for instance be used to block or promote slicing, include or exclude exons and influence the expression of specific isoforms and/or stimulate the expression of alternative protein products. Such applications are described in more detail below.

A RNA targeting effector protein binding to a target RNA can sterically block access of splicing factors to the RNA sequence. The RNA targeting effector protein targeted to a splice site may block splicing at the site, optionally redirecting splicing to an adjacent site.

In certain embodiments, through appropriate selection of gRNA, specific splice variants may be targeted, while other splice variants will not be targeted.

In some cases the RNA targeting effector protein can be used to promote splicing (e.g. where splicing is defective). For instance, a RNA targeting effector protein can be associated with an effector capable of stabilizing a splicing regulatory stem-loop in order to further splicing. The RNA targeting effector protein can be linked to a consensus binding site sequence for a specific splicing factor in order to recruit the protein to the target DNA.

The RNA targeting effector protein can be used to include an exon by recruiting a splicing factor (such as U1) to a 5' splicing site to promote excision of introns around a desired exon. Such recruitment could be mediated through a fusion with an arginine/serine rich domain, which functions as splicing activator (Gravely B R and Maniatis T, Mol Cell. 1998 (5):765-71). It is envisaged that the RNA targeting effector protein can be used to block the splicing machinery at a desired locus, resulting in preventing exon recognition and the expression of a different protein product. The RNA targeting effector protein can be paired with splice junctions or exonic splicing enhancers (ESEs) thereby preventing exon recognition, resulting in the translation of a partially functional protein.

b) RNA Modification

RNA editing is a natural process whereby the diversity of gene products of a given sequence is increased by minor modification in the RNA. In humans, typically, the modification involves the conversion of adenosine (A) to inosine (I), resulting in an RNA sequence which is different from that encoded by the genome. This RNA modification is generally ensured by the ADAR enzyme, whereby the pre-RNA target forms an imperfect duplex RNA by base-pairing between the exon that contains the adenosine to be edited and an intronic non-coding element. A classic example of A-I editing is the glutamate receptor GluR-B mRNA, whereby the change results in modified conductance properties of the channel (Higuchi M, et al. Cell. 1993; 75:1361-70). In plants, RNA editing occurs in both plastids and mitochondria and typically involves the changing of specific C nucleotides to U. The pentatricopeptide repeat (PPR) family of proteins has been shown to be involved in this process. The process allows correcting base pairs to restore an RNA sequence and also plays a role in modulating gene expression (Grennan, Plant Physiology, 2011).

In humans, a heterozygous functional-null mutation in the ADAR1 gene leads to a skin disease, human pigmentary genodermatosis (Miyamura Y, et al. Am J Hum Genet. 2003; 73:693-9). It is envisaged that the RNA targeting effector proteins of the present invention can be used to correct malfunctioning RNA modification also in plants.

It is further envisaged that RNA adenosine methylase (N(6)-methyladenosine) can be fused to the RNA targeting effector proteins of the invention and targeted to a transcript of interest. This methylase causes reversible methylation, has regulatory roles and may affect gene expression and cell fate decisions by modulating multiple RNA-related cellular pathways (Fu et al Nat Rev Genet. 2014; 15(5):293-306).

c) Polyadenylation

Polyadenylation of an mRNA is important for nuclear transport, translation efficiency and stability of the mRNA. All of these, as well as the process of polyadenylation, depend on specific RBPs. Most eukaryotic mRNAs receive a 3' poly(A) tail of about 200 nucleotides after transcription. Polyadenylation involves different RNA-binding protein complexes which stimulate the activity of a poly(A)polymerase (Minvielle-Sebastia L et al. Curr Opin Cell Biol. 1999; 11:352-7). It is envisaged that the RNA-targeting effector proteins provided herein can be used to interfere with or promote the interaction between the RNA-binding proteins and RNA.

d) RNA Export

After pre-mRNA processing, the mRNA is exported from the nucleus to the cytoplasm. This is ensured by a cellular mechanism which involves the generation of a carrier complex, which is then translocated through the nuclear pore and releases the mRNA in the cytoplasm, with subsequent recycling of the carrier.

Overexpression of proteins (such as TAP) which play a role in the export of RNA has been found to increase export of transcripts that are otherwise inefficiently exported in *Xenopus* (Katahira J, et al. EMBO J. 1999; 18:2593-609).

e) mRNA Localization mRNA localization ensures spatially regulated protein production. Localization of transcripts to a specific region of the cell can be ensured by localization elements. In particular embodiments, it is envisaged that the CRISPR effector proteins described herein can be used to target localization elements to the RNA of interest. The effector proteins can be designed to bind the target transcript and shuttle them to a location in the cell determined by its peptide signal tag. More particularly for instance, a RNA targeting CRISPR effector protein fused to a nuclear localization signal (NLS) can be used to alter RNA localization.

Further examples of localization signals include the zipcode binding protein (ZBP1) which ensures localization of β-actin to the cytoplasm in several asymmetric cell types, KDEL retention sequence (localization to endoplasmic reticulum), nuclear export signal (localization to cytoplasm), mitochondrial targeting signal (localization to mitochondria), peroxisomal targeting signal (localization to peroxisome) and m6A marking/YTHDF2 (localization to p-bodies). Other approaches that are envisaged are fusion of the RNA targeting effector protein with proteins of known localization (for instance membrane, synapse).

Alternatively, the effector protein according to the invention may for instance be used in localization-dependent knockdown. By fusing the CRISPR effector protein to an appropriate localization signal, the effector is targeted to a particular cellular compartment. Only target RNAs residing in this compartment will effectively be targeted, whereas otherwise identical targets, but residing in a different cellular compartment will not be targeted, such that a localization dependent knockdown can be established.

F) Translation

The RNA targeting effector proteins described herein can be used to enhance or repress translation. It is envisaged that upregulating translation is a very robust way to control cellular circuits. Further, for functional studies, a protein translation screen can be favorable over transcriptional upregulation screens, which have the shortcoming that upregulation of transcript does not translate into increased protein production. Moreover, translational upregulation could, for example, be used to enhance the amount of a protein that is involved in the defense of a cell against a pathogen such as a protein encoded by a resistance gene.

It is envisaged that the RNA targeting effector proteins described herein can be used to bring translation initiation factors, such as EIF4G in the vicinity of the 5' untranslated repeat (5'UTR) of a messenger RNA of interest to drive translation (as described in De Gregorio et al. EMBO J. 1999; 18(17):4865-74 for a non-reprogrammable RNA binding protein). As another example, GLD2, a cytoplasmic poly(A) polymerase, can be recruited to the target mRNA by an RNA targeting effector protein. This would allow for directed polyadenylation of the target mRNA thereby stimulating translation.

Similarly, the RNA targeting CRISPR effector proteins envisaged herein can be used to block translational repressors of mRNA, such as ZBP1 (Huttelmaier S, et al. Nature. 2005; 438:512-5). By binding to translation initiation site of a target RNA, translation can be directly affected.

In addition, fusing the RNA targeting effector proteins to a protein that stabilizes mRNAs, e.g. by preventing degradation thereof such as RNase inhibitors, it is possible to increase protein production from the transcripts of interest.

It is envisaged that the RNA targeting effector proteins described herein can be used to repress translation by binding in the 5'UTR regions of a RNA transcript and preventing the ribosome from forming and beginning translation.

Further, the RNA targeting effector protein can be used to recruit Cafl, a component of the CCR4-NOT deadenylase complex, to the target mRNA, resulting in deadenylation or the target transcript and inhibition of protein translation.

For instance, the RNA targeting effector protein of the invention can be used to increase or decrease translation of proteins relevant to a specific trait of interest. For example, the translation of an mRNA encoded by a resistance gene may be upregulated in order to increase plant resistance to a plant pathogen. These resistance genes may be endogenously or exogenously expressed in the plant. For example, it has been shown that Resistance to *Phytophora infestans* (RPi) genes could be used to engineer pathogen resistant crops (Witek et al., Nature Biotechnology, 2016). Upregulation of the translation of such a gene may further enhance resistance. Alternatively, upregulation of translation may be of interest in metabolic and food engineering. For example, the translation of acetolactate synthase (ALS) could be enhanced to promote branched chain amino acid synthesis. This may increase herbicide resistance of the plant, in particular if the translation of a Herbicide-Resistant Acetolactate Synthase is upregulated. Also, upregulating the translation of proteins involved in the production of volatile organic compounds (VOCs) (Dudareva et al., New Phytologist, 2013) such as patchoulol synthase, e.g. from tobacco, linalool/nerolidol synthase, e.g. from strawberry, or E-(β)-caryophyllene synthase, e.g. from rice or oregano, may be envisaged in order to engineer floral or defense related VOCs thus favouring pollination or fruit flavor or enhancing defense against herbivores and/or plant pathogens.

j) mRNA Turnover

Translation is tightly coupled to mRNA turnover and regulated mRNA stability. It can be envisaged that the RNA-targeting effector proteins of the present invention can be used to interfere with or to promote the activity of proteins acting to stabilize mRNA transcripts, such that mRNA turnover is affected It is further envisaged that the RNA-targeting effector proteins described herein can be used to promote degradation of target transcripts. For instance, m6A methyltransferase can be recruited to the target transcript to localize the transcript to P-bodies leading to degradation of the target.

As yet another example, an RNA targeting effector protein as described herein can be fused to the non-specific endonuclease domain PilT N-terminus (PIN), to recruit it to a target transcript and allow degradation thereof.

H) Interaction with Multi-Functional Proteins

Some RNA-binding proteins bind to multiple sites on numerous RNAs to function in diverse processes. For instance, the hnRNP A1 protein has been found to bind exonic splicing silencer sequences, antagonizing the splicing factors, associate with telomere ends (thereby stimulating telomere activity) and bind miRNA to facilitate Drosha-mediated processing thereby affecting maturation. It is envisaged that the RNA-binding effector proteins of the present invention can interfere with the binding of RNA-binding proteins at one or more locations.

i) RNA Folding

RNA adopts a defined structure in order to perform its biological activities. Transitions in conformation among alternative tertiary structures are critical to most RNA-mediated processes. However, RNA folding can be associated with several problems. For instance, RNA may have a tendency to fold into, and be upheld in, improper alternative conformations and/or the correct tertiary structure may not be sufficiently thermodynamically favored over alternative structures. The RNA targeting effector protein, in particular a cleavage-deficient or dead RNA targeting protein, of the invention may be used to direct folding of (m)RNA and/or capture the correct tertiary structure thereof.

Use of RNA-Targeting Effector Protein in Modulating Cellular Status

In certain embodiments a CRISPR effector protein such as C2c2 in a complex with crRNA is activated upon binding to target RNA and subsequently cleaves any nearby ssRNA targets (i.e. "collateral" or "bystander" effects). C2c2, once primed by the cognate target, can cleave other (non-complementary) RNA molecules. Such promiscuous RNA cleavage could potentially cause cellular toxicity, or otherwise affect cellular physiology or cell status. In particular this collateral activity may induce cell dormancy or cell death.

Accordingly, in certain embodiments, the non-naturally occurring or engineered composition, vector system, or delivery systems as described herein are used for or are for use in induction of cell dormancy. In certain embodiments, the non-naturally occurring or engineered composition, vector system, or delivery systems as described herein are used for or are for use in induction of cell cycle arrest. In certain embodiments, the non-naturally occurring or engineered composition, vector system, or delivery systems as described herein are used for or are for use in reduction of cell growth and/or cell proliferation, In certain embodiments, the non-naturally occurring or engineered composition, vector system, or delivery systems as described herein are used for or are for use in induction of cell anergy. In certain embodiments, the non-naturally occurring or engineered composition, vector system, or delivery systems as described herein are used for or are for use in induction of cell apoptosis. In certain embodiments, the non-naturally occurring or engineered composition, vector system, or delivery systems as described herein are used for or are for use in induction of cell necrosis. In certain embodiments, the non-naturally occurring or engineered composition, vector system, or delivery systems as described herein are used for or are for use in induction of cell death. In certain embodiments, the non-naturally occurring or engineered composition, vector system, or delivery systems as described herein are used for or are for use in induction of programmed cell death.

In certain embodiments, the invention relates to a method for induction of cell dormancy comprising introducing or inducing the non-naturally occurring or engineered composition, vector system, or delivery systems as described herein. In certain embodiments, the invention relates to a method for induction of cell cycle arrest comprising introducing or inducing the non-naturally occurring or engineered composition, vector system, or delivery systems as described herein. In certain embodiments, the invention relates to a method for reduction of cell growth and/or cell proliferation comprising introducing or inducing the non-naturally occurring or engineered composition, vector system, or delivery systems as described herein. In certain embodiments, the invention relates to a method for induction of cell anergy comprising introducing or inducing the non-naturally occurring or engineered composition, vector system, or delivery systems as described herein. In certain embodiments, the invention relates to a method for induction of cell apoptosis comprising introducing or inducing the non-naturally occurring or engineered composition, vector system, or delivery systems as described herein. In certain embodiments, the invention relates to a method for induction of cell necrosis comprising introducing or inducing the non-naturally occurring or engineered composition, vector system, or delivery systems as described herein. In certain embodiments, the invention relates to a method for induction of cell death comprising introducing or inducing the non-naturally occurring or engineered composition, vector system, or delivery systems as described herein. In certain embodiments, the invention relates to a method for induction of programmed cell death comprising introducing or inducing the non-naturally occurring or engineered composition, vector system, or delivery systems as described herein.

The methods and uses as described herein may be therapeutic or prophylactic and may target particular cells, cell (sub)populations, or cell/tissue types. In particular, the methods and uses as described herein may be therapeutic or prophylactic and may target particular cells, cell (sub) populations, or cell/tissue types expressing one or more target sequences, such as one or more particular target RNA (e.g. ssRNA). Without limitation, target cells may for instance be plant cells expressing a particular transcript, preferably cells infected by a specific (e.g. viral) pathogen, etc.

Accordingly, in certain embodiments, the invention relates to a method for treating a pathological condition characterized by the presence of undesirable cells (host cells), comprising introducing or inducing the non-naturally occurring or engineered composition, vector system, or delivery systems as described herein. In certain embodiments, the invention relates the use of the non-naturally occurring or engineered composition, vector system, or delivery systems as described herein for treating a pathological condition characterized by the presence of undesirable cells (host cells). In certain embodiments, the invention relates the non-naturally occurring or engineered composition, vector system, or delivery systems as described herein for use in treating a pathological condition characterized by the presence of undesirable cells (host cells). It is to be understood that preferably the CRISPR-Cas system targets a target specific for the undesirable cells. In certain embodiments, the invention relates to the use of the non-naturally occurring or engineered composition, vector system, or delivery systems as described herein for treating, preventing, or alleviating infection of cells by a pathogen. In certain embodiments, the invention relates to the non-naturally occurring or engineered composition, vector system, or delivery systems as described herein for use in treating, preventing, or alleviating infection of cells by a pathogen. In certain embodiments, the invention relates to a method for treating, preventing, or alleviating infection of cells by a pathogen comprising introducing or inducing the non-naturally occurring or engineered composition, vector system, or delivery systems as described herein. It is to be understood that preferably the CRISPR-Cas system targets a target specific for the cells infected by the pathogen (e.g. a pathogen derived target). Preferably, the pathogen is a plant pathogen.

Use of RNA-Targeting Effector Protein in RNA Detection or Protein Detection

It is further envisaged that the RNA targeting effector protein can be used in Northern blot assays. Northern blotting involves the use of electrophoresis to separate RNA samples by size. The RNA targeting effector protein can be used to specifically bind and detect the target RNA sequence.

A RNA targeting effector protein can also be fused to a fluorescent protein (such as GFP) and used to track RNA localization in living cells. More particularly, the RNA targeting effector protein can be inactivated in that it no longer cleaves RNA. In particular embodiments, it is envisaged that a split RNA targeting effector protein can be used, whereby the signal is dependent on the binding of both subproteins, in order to ensure a more precise visualization. Alternatively, a split fluorescent protein can be used that is reconstituted when multiple RNA targeting effector protein complexes bind to the target transcript. It is further envisaged that a transcript is targeted at multiple binding sites along the mRNA so the fluorescent signal can amplify the true signal and allow for focal identification. As yet another alternative, the fluorescent protein can be reconstituted to form a split intein.

RNA targeting effector proteins are for instance suitably used to determine the localization of the RNA or specific splice variants, the level of mRNA transcript, up- or down regulation of transcripts and disease-specific diagnosis. The RNA targeting effector proteins can be used for visualization of RNA in (living) cells using e.g. fluorescent microscopy or flow cytometry, such as fluorescence-activated cell sorting (FACS) which allows for high-throughput screening of cells and recovery of living cells following cell sorting. Further, expression levels of different transcripts can be assessed simultaneously under stress, e.g. under biotic or abiotic stress.

In certain embodiments, the components or complexes according to the invention as described herein can be used in multiplexed error-robust fluorescence in situ hybridization (MERFISH; Chen et al. Science; 2015; 348(6233)), such as, for instance, with (fluorescently) labeled C2c2 effectors.

In Vitro Apex Labeling

Cellular processes depend on a network of molecular interactions among protein, RNA, and DNA. Accurate detection of protein-DNA and protein-RNA interactions is key to understanding such processes. In vitro proximity labeling technology employs an affinity tag combined with e.g. a photoactivatable probe to label polypeptides and RNAs in the vicinity of a protein or RNA of interest in vitro. After UV irradiation the photoactivatable group reacts with proteins and other molecules that are in close proximity to the tagged molecule, thereby labelling them. Labelled interacting molecules can subsequently be recovered and identified. The RNA targeting effector protein of the invention can, for instance, be used to target a probe to a selected RNA sequence.

These applications could also be applied in plants for in vivo imaging of disease relevant applications or difficult-to culture cell types.

Use of RNA-Targeting Effector Protein in RNA Origami/In Vitro Assembly Lines—Combinatorics RNA origami refers to nanoscale folded structures for creating two-dimensional or three-dimensional structures using RNA as integrated template. The folded structure is encoded in the RNA and the shape of the resulting RNA is thus determined by the synthesized RNA sequence (Geary, et al. 2014. Science, 345 (6198). pp. 799-804). The RNA origami may act as scaffold for arranging other components, such as proteins, into complexes. The RNA targeting effector protein of the invention can, for instance, be used to target proteins of interest to the RNA origami using a suitable guide RNA.

Use of RNA-Targeting Effector Protein in RNA Isolation or Purification, Enrichment or Depletion It is further envisaged that the RNA targeting effector protein when complexed to RNA can be used to isolate and/or purify the RNA. The RNA targeting effector protein can, for instance, be fused to an affinity tag that can be used to isolate and/or purify the RNA-RNA targeting effector protein complex. Such applications are for instance useful in the analysis of gene expression profiles in cells. In particular embodiments, it can be envisaged that the RNA targeting effector proteins can be used to target a specific noncoding RNA (ncRNA) thereby blocking its activity, providing a useful functional probe. In certain embodiments, the effector protein as described herein may be used to specifically enrich for a particular RNA (including, but not limited to, increasing stability, etc.), or alternatively to specifically deplete a particular RNA (such as, without limitation for instance, particular splice variants, isoforms, etc.).

Interrogation of lincRNA Function and Other Nuclear RNAs

Current RNA knockdown strategies such as siRNA have the disadvantage that they are mostly limited to targeting cytosolic transcripts since the protein machinery is cytosolic. The advantage of a RNA targeting effector protein of the present invention, an exogenous system that is not essential to cell function, is that it can be used in any compartment in the cell. By fusing a NLS signal to the RNA targeting effector protein, it can be guided to the nucleus, allowing nuclear RNAs to be targeted. It is, for instance, envisaged to probe the function of lincRNAs. Long intergenic non-coding RNAs (lincRNAs) are a vastly underexplored area of research. Most lincRNAs have as of yet unknown functions which could be studied using the RNA targeting effector protein of the invention.

Identification of RNA Binding Proteins

Identifying proteins bound to specific RNAs can be useful for understanding the roles of many RNAs. For instance, many lincRNAs associate with transcriptional and epigenetic regulators to control transcription. Understanding what proteins bind to a given lincRNA can help elucidate the components in a given regulatory pathway. A RNA targeting effector protein of the invention can be designed to recruit a biotin ligase to a specific transcript in order to label locally bound proteins with biotin. The proteins can then be pulled down and analyzed by mass spectrometry to identify them.

Assembly of Complexes on RNA and Substrate Shuttling

RNA targeting effector proteins of the invention can further be used to assemble complexes on RNA. This can be achieved by functionalizing the RNA targeting effector protein with multiple related proteins (e.g. components of a particular synthesis pathway). Alternatively, multiple RNA targeting effector proteins can be functionalized with such different related proteins and targeted to the same or adjacent target RNA. Useful application of assembling complexes on RNA are, for instance, facilitating substrate shuttling between proteins.

Synthetic Biology

The development of biological systems have a wide utility. It is envisaged that the programmable RNA targeting effector proteins of the invention can be used to split proteins of toxic domains for targeted cell death, for instance, using a pathogen specific RNA as target transcript. Further, pathways involving protein-protein interaction can be influenced in synthetic biological systems with e.g. fusion complexes with the appropriate effectors such as kinases or other enzymes.

Protein Splicing: Inteins

Protein splicing is a post-translational process in which an intervening polypeptide, referred to as an intein, catalyzes its own excision from the polypeptides flanking it, referred to as exteins, as well as subsequent ligation of the exteins. The assembly of two or more RNA targeting effector proteins as described herein on a target transcript could be used to direct the release of a split intein (Topilina and Mills Mob DNA. 2014 Feb. 4; 5(1):5), thereby allowing for direct computation of the existence of a mRNA transcript and subsequent release of a protein product, such as a metabolic enzyme or a transcription factor (for downstream actuation of transcription pathways). This application may have significant relevance in synthetic biology (see above) or large-scale bio-production (only produce product under certain conditions).

Inducible, Dosed and Self-Inactivating Systems

In one embodiment, fusion complexes comprising an RNA targeting effector protein of the invention and an effector component are designed to be inducible, for instance, light inducible or chemically inducible. Such inducibility allows for activation of the effector component at a desired moment in time.

Light inducibility is for instance achieved by designing a fusion complex wherein CRY2 PHR/CIBN pairing is used for fusion. This system is particularly useful for light induction of protein interactions in living cells (Konermann S, et al. Nature. 2013; 500:472-476).

Chemical inducibility is, for instance, provided for by designing a fusion complex wherein FKBP/FRB (FK506 binding protein/FKBP rapamycin binding) pairing is used for fusion. Using this system, rapamycin is required for binding of proteins (Zetsche et al. Nat Biotechnol. 2015; 33(2):139-42 describes the use of this system for Cas9).

Further, when introduced in the cell as DNA, the RNA targeting effector protein of the inventions can be modulated by inducible promoters, such as tetracycline or doxycycline controlled transcriptional activation (Tet-On and Tet-Off expression system), hormone inducible gene expression system such as, for instance, an ecdysone inducible gene expression system and an arabinose-inducible gene expression system. When delivered as RNA, expression of the RNA targeting effector protein can be modulated via a riboswitch, which can sense a small molecule like tetracycline (as described in Goldfless et al. Nucleic Acids Res. 2012; 40(9):e64).

In one embodiment, the delivery of the RNA targeting effector protein of the invention can be modulated to change the amount of protein or crRNA in the cell, thereby changing the magnitude of the desired effect or any undesired off-target effects.

In one embodiment, the RNA targeting effector proteins described herein can be designed to be self-inactivating. When delivered to a cell as RNA, either mRNA or as a replication RNA therapeutic (Wrobleska et al Nat Biotechnol. 2015 August; 33(8): 839-841), they can self-inactivate expression and subsequent effects by destroying their own RNA, thereby reducing residency and potential undesirable effects.

For further in vivo applications of RNA targeting effector proteins as described herein, reference is made to Mackay J P et al (Nat Struct Mol Biol. 2011 March; 18(3):256-61), Nelles et al (Bioessays. 2015 July; 37(7):732-9) and Abil Z and Zhao H (Mol Biosyst. 2015 October; 11(10):2658-65), which are incorporated herein by reference. In particular, the following applications are envisaged in certain embodiments of the invention, preferably in certain embodiments by using a catalytically inactive CRISPR effector protein; in particular, a catalytically inactive C2c2: enhancing translation (e.g. CRISPR effector protein—translation promotion factor fusions (e.g. eIF4 fusions)); repressing translation (e.g. gRNA targeting ribosome binding sites); exon skipping (e.g. gRNAs targeting splice donor and/or acceptor sites); exon inclusion (e.g. gRNA targeting a particular exon splice donor and/or acceptor site to be included or CRISPR effector protein fused to or recruiting spliceosome components (e.g. U1 snRNA)); accessing RNA localization (e.g. CRISPR effector protein—marker fusions (e.g. EGFP fusions)); altering RNA localization (e.g. CRISPR effector protein—localization signal fusions (e.g. NLS or NES fusions)); RNA degradation (in this case no catalytically inactive CRISPR effector protein is to be used if relied on the activity of CRISPR effector protein alternatively and for increased specificity, a split CRISPR effector protein may be used); inhibition of non-coding RNA function (e.g. miRNA), such as by degradation or binding of gRNA to functional sites (possibly titrating out at specific sites by relocalization by CRISPR effector protein-signal sequence fusions). In all these applications, the CRISPR effector protein is preferably a C2c2 effector protein.

As described herein before, C2c2 function is robust to 5' or 3' extensions of the crRNA and to extension of the crRNA loop. It is therefore envisaged that MS2 loops and other recruitment domains can be added to the crRNA without affecting complex formation and binding to target transcripts. Such modifications to the crRNA for recruitment of various effector domains are applicable in the uses of the RNA targeted effector proteins described above.

It has been shown that C2c2, in particular LshC2c2, is capable of mediating resistance to RNA phages. It is therefore envisaged that C2c2 can be used to immunize plants against RNA-based pathogens. In particular, it is envisaged to use a CRISPR effector system of the invention (preferably a C2c2 system) to confer or increase resistance of a plant to a plant pathogen, in particular to a plant RNA virus such as Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), *Citrus tristeza* virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis* mosaic virus (ArMV), or *Rupestris* stem pitting-associated virus (RSPaV). This can be achieved in the form of a treatment by transiently delivering the components of the CRISPR system, i.e. the CRISPR effector protein and the nucleic acid component(s) to the plant or plant cell post-infection to reduce damage or prophylactically by repeated transient delivery or by stably integrating one or more components of the CRISPR system.

It has also been shown that C2c2 processes (cleaves) its own array. This applies to both the wildtype C2c2 protein and the mutated C2c2 protein containing one or more mutated amino acid residues R597, H602, R1278 and H1283, such as one or more of the modifications selected from R597A, H602A, R1278A and H1283A. It is therefore envisaged that multiple crRNAs designed for different target transcripts and/or applications can be delivered as a single pre-crRNA or as a single transcript driven by one promoter. Such method of delivery has the advantages that it is substantially more compact, easier to synthesize and easier to deliver in viral systems. Preferably, amino acid numbering as described herein refers to Lsh C2c2 protein. It will be understood that exact amino acid positions may vary for orthologues of Lsh C2c2, which can be adequately determined by protein alignment, as is known in the art, and as described herein elsewhere.

Aspects of the invention also encompass methods and uses of the compositions and systems described herein, transcriptome engineering, e.g. for altering or manipulating the (protein) expression of one or more genes or the one or more gene products, in prokaryotic or eukaryotic cells, in vitro, in vivo or ex vivo.

In an aspect, the invention provides methods and compositions for modulating, e.g., reducing (protein) expression of a target RNA in cells. In the subject methods, a CRISPR system of the invention is provided that interferes with transcription, stability, and/or translation of an RNA.

In certain embodiments, an effective amount of CRISPR system is used to cleave RNA or otherwise inhibit RNA expression. In this regard, the system has uses similar to siRNA and shRNA, and thus can also be substituted for such methods. The method includes, without limitation, use of a CRISPR system as a substitute for e.g., an interfering ribonucleic acid (such as an siRNA or shRNA) or a transcription template thereof, e.g., a DNA encoding an shRNA. The CRISPR system is introduced into a target cell, e.g., by being administered to a plant that includes the target cell.

Advantageously, a CRISPR system of the invention is specific. For example, whereas interfering ribonucleic acid (such as an siRNA or shRNA) polynucleotide systems are plagued by design and stability issues and off-target binding, a CRISPR system of the invention, in particular a C2c2 system, can be designed with high specificity.

Destabilized C2c2

In certain embodiments, the effector protein (CRISPR enzyme; C2c2) according to the invention as described herein is associated with or fused to a destabilization domain (DD). In some embodiments, the DD is ER50. A corresponding stabilizing ligand for this DD is, in some embodiments, 4HT. As such, in some embodiments, one of the at least one DDs is ER50 and a stabilizing ligand therefor is 4HT or CMP8. In some embodiments, the DD is DHFR50. A corresponding stabilizing ligand for this DD is, in some embodiments, TMP. As such, in some embodiments, one of the at least one DDs is DHFR50 and a stabilizing ligand therefor is TMP. In some embodiments, the DD is ER50. A corresponding stabilizing ligand for this DD is, in some embodiments, CMP8. CMP8 may therefore be an alternative stabilizing ligand to 4HT in the ER50 system. While it may be possible that CMP8 and 4HT can/should be used in a competitive matter, some cell types may be more susceptible to one or the other of these two ligands, and from this disclosure and the knowledge in the art, the skilled person can use CMP8 and/or 4HT.

In some embodiments, one or two DDs may be fused to the N-terminal end of the CRISPR enzyme with one or two DDs fused to the C-terminal of the CRISPR enzyme. In some embodiments, the at least two DDs are associated with the CRISPR enzyme and the DDs are the same DD, i.e. the DDs are homologous. Thus, both (or two or more) of the DDs could be ER50 DDs. This is preferred in some embodiments. Alternatively, both (or two or more) of the DDs could be DHFR50 DDs. This is also preferred in some embodiments. In some embodiments, the at least two DDs are associated with the CRISPR enzyme and the DDs are different DDs, i.e. the DDs are heterologous. Thus, one of the DDS could be ER50 while one or more of the DDs or any other DDs could be DHFR50. Having two or more DDs which are heterologous may be advantageous as it would provide a greater level of degradation control. A tandem fusion of more than one DD at the N- or C-terminal may enhance degradation; and such a tandem fusion can be, for example, ER50-ER50-C2c2 or DHFR-DHFR-C2c2. It is envisaged that high levels of degradation would occur in the absence of either stabilizing ligand, intermediate levels of degradation would occur in the absence of one stabilizing ligand and the presence of the other (or another) stabilizing ligand, while low levels of degradation would occur in the presence of both (or two of more) of the stabilizing ligands. Control may also be imparted by having an N-terminal ER50 DD and a C-terminal DHFR50 DD.

In some embodiments, the fusion of the CRISPR enzyme with the DD comprises a linker between the DD and the CRISPR enzyme. In some embodiments, the linker is a GlySer linker. In some embodiments, the DD-CRISPR enzyme further comprises at least one Nuclear Export Signal (NES). In some embodiments, the DD-CRISPR enzyme comprises two or more NESs. In some embodiments, the DD-CRISPR enzyme comprises at least one Nuclear Localization Signal (NLS). This may be in addition to an NES. In some embodiments, the linker between the CRISPR enzyme and the DD comprises or consists essentially of or consists of a localization (nuclear import or export) signal. HA or Flag tags are also within the ambit of the invention as linkers. Applicants use NLS and/or NES as linker and also use Glycine Serine linkers as short as GS up to (GGGGS)3 (SEQ ID NO: 44).

Application of RNA Targeting/RNA Targeting-CRISPR System to Plants and Yeast

Definitions

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise, without limitation, angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussels sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses algae, which are mainly photoautotrophs unified primarily by their lack of roots, leaves and other organs that characterize higher plants.

The methods for modulating gene expression using the RNA targeting system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape) and plants used for experimental purposes (e.g., *Arabidopsis*). Thus, the methods and CRISPR-Cas systems can be used over a broad range of plants, such as for example, with dicotyledonous plants belonging to the orders Magniolales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g those belonging to the orders Pinales, Ginkgoales, Cycadales, Araucariales, Cupressales and Gnetales.

The RNA targeting CRISPR systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis,* and *Vigna*; and the genera *Alium, Andropogon, Aragrostis, Asparagus, Avena, Cynodon, Elaeis, Festuca, Festulolium, Heterocallis, Hordeum, Lemna, Lolium, Musa, Oryza, Panicum, Pannesetum, Phleum, Poa, Secale, Sorghum, Triticum, Zea, Abies, Cunninghamia, Ephedra, Picea, Pinus,* and *Pseudotsuga*.

The RNA targeting CRISPR systems and methods of use can also be used over a broad range of "algae" or "algae cells"; including for example algae selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Anikstrodesmis, Botryococcus, Chaetoceros, Chlamydomonas, Chlorella, Chlorococcum, Cyclotella, Cylindrotheca, Dunaliella,*

*Emiliana, Euglena, Hematococcus, Isochrysis, Monochrysis, Monoraphidium, Nannochloris, Nannnochloropsis, Navicula, Nephrochloris, Nephroselmis, Nitzschia, Nodularia, Nostoc, Oochromonas, Oocystis, Oscillartoria, Pavlova, Phaeodactylum, Playtmonas, Pleurochrysis, Porhyra, Pseudoanabaena, Pyramimonas, Stichococcus, Synechococcus, Synechocystis, Tetraselmis, Thalassiosira,* and *Trichodesmium.*

A part of a plant, i.e., a "plant tissue" or "plant part" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized units, such as, for example, plant tissue, a plant organ, or a whole plant. The term "plant cell" as used herein also encompasses plant protoplasts.

A "protoplast" refers to a plant cell that has had its protective cell wall completely or partially removed using, for example, mechanical or enzymatic means resulting in an intact biochemical competent unit of living plant that can reform their cell wall, proliferate, regenerate and grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells. Examples of plant promoters include, for example, the Cauliflower Mosaic Virus CaMV35S promoter and the maize ubiquitin gene Ubi promoter. Preferred promotors for the expression of a C2c2 effector protein include the rice actin promoter for monocots and the 35S promoter for dicots. The gRNA may preferably be under a rice U6 promoter in monocots or under a *arabidopsis* U6 promoter in dicots.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerevisiae, Kluyveromyces marxianus,* or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis,* a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guide RNA may more often be a rate-limiting component in genome engineering of polyploid cells than in haploid cells, and thus the methods using the C2c2 CRISPRS system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence or gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2 plasmids, yeast integrative plasmids, yeast replicative plasmids, shuttle vectors, and episomal plasmids.

Stable Integration of RNA Targeting CRISP System Components in the Genome of Plants and Plant Cells In particular embodiments, it is envisaged that the polynucleotides encoding the components of the RNA targeting CRISPR system are introduced for stable integration into the genome of a plant cell. In these embodiments, the design of the transformation vector or the expression system can be adjusted depending on when, where and under what conditions the guide RNA and/or the RNA targeting gene(s) are expressed.

In particular embodiments, it is envisaged to introduce the components of the RNA targeting CRISPR system stably into the genomic DNA of a plant cell. Additionally or alternatively, it is envisaged to introduce the components of the RNA targeting CRISPR system for stable integration into the DNA of a plant organelle such as, but not limited to, a plastid, a mitochondrion or a chloroplast.

The expression system for stable integration into the genome of a plant cell may contain one or more of the following elements: a promoter element that can be used to express the guide RNA and/or RNA targeting enzyme in a plant cell; a 5' untranslated region to enhance expression; an intron element to further enhance expression in certain cells, such as monocot cells; a multiple-cloning site to provide convenient restriction sites for inserting the one or more guide RNAs and/or the RNA targeting gene sequences and other desired elements; and a 3' untranslated region to provide for efficient termination of the expressed transcript.

The elements of the expression system may be on one or more expression constructs which are either circular, such as a plasmid or transformation vector, or non-circular, such as linear double stranded DNA.

In a particular embodiment, a RNA targeting CRISPR expression system comprises at least:
   (a) a nucleotide sequence encoding a guide RNA (gRNA) that hybridizes with a target sequence in a plant, and wherein the guide RNA comprises a guide sequence and a direct repeat sequence, and
   (b) a nucleotide sequence encoding a RNA targeting protein,
   wherein components (a) or (b) are located on the same or on different constructs, and whereby the different nucleotide sequences can be under control of the same or a different regulatory element operable in a plant cell.

DNA construct(s) containing the components of the RNA targeting CRISPR system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom. In one example embodiment, the DNA construct containing the components of the CRISPR system may be a pAHC17 vector.

In particular embodiments, the DNA construct may be introduced into the plant cell using techniques such as, but not limited to, electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene(s) of interest toward cells, resulting in the penetration of the protoplasm by the particles and typically stable integration into the genome. (see e.g. Klein et al, Nature (1987), Klein et ah, Bio/Technology (1992), Casas et ah, Proc. Natl. Acad. Sci. USA (1993)).

In particular embodiments, the DNA constructs containing components of the RNA targeting CRISPR system may be introduced into the plant by *Agrobacterium*-mediated transformation. The DNA constructs may be combined with suitable T-DNA flanking regions and introduced into a conventional *Agrobacterium tumefaciens* or Ensifer host vector. The foreign DNA can be incorporated into the genome of plants by infecting the plants or by incubating plant protoplasts with *Agrobacterium* bacteria, containing one or more Ti (tumor-inducing) plasmids (see e.g. Fraley et al., (1985), Rogers et al., (1987), U.S. Pat. No. 5,563,055. US20140273235 which describes the transformation of CRISPR components into plant material using different methods is incorporated by reference herein.

Plant Promoters

In order to ensure appropriate expression in a plant cell, the components of the CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. The present invention envisages methods for modifying RNA sequences and, as such, also envisages regulating expression of plant biomolecules. In particular embodiments of the present invention, it is thus advantageous to place one or more elements of the RNA targeting CRISPR system under the control of a promoter that can be regulated. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular, placing one or more elements of the RNA targeting CRISPR system under the control of a promoter that directs expression of a gene in response to infection with a plant pathogen is envisaged. In particular embodiments, one or more of the RNA targeting CRISPR components are expressed under the control of a constitutive promoter, such as the cauliflower mosaic virus 35S promoter. Tissue-preferred promoters can be utilized to target enhanced expression in certain cell types within a particular plant tissue, for instance vascular cells in leaves or roots or in specific cells of the seed. Examples of particular promoters for use in the RNA targeting CRISPR system—are found in Kawamata et al., (1997) Plant Cell Physiol 38:792-803; Yamamoto et al., (1997) Plant J 12:255-65; Hire et al, (1992) Plant Mol Biol 20:207-18; Kuster et al, (1995) Plant Mol Biol 29:759-72; and Capana et al., (1994) Plant Mol Biol 25:681-91. Preferred promotors for the expression of a C2c2 effector protein include the rice actin promoter for monocots and the 35S promoter for dicots. The gRNA may preferably be under a rice U6 promoter in monocots or under a arabidopsis U6 promoter in dicots.

Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome), such as a Light Inducible Transcriptional Effector (LITE) that direct changes in transcriptional activity in a sequence-specific manner. The components of a light inducible system may include a RNA targeting CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promoters, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the RNA targeting CRISPR system is used to specifically modify expression and/or translation of chloroplast genes or to ensure expression in the chloroplast. For this purpose, use is made of chloroplast transformation methods or compartmentalization of the RNA targeting CRISPR components to the chloroplast. For instance, the introduction of genetic modifications in the plastid genome can reduce biosafety issues such as gene flow through pollen.

Methods of chloroplast transformation are known in the art and include particle bombardment, PEG treatment, and microinjection. Additionally, methods involving the translocation of transformation cassettes from the nuclear genome to the plastid can be used as described in WO2010061186.

Alternatively, it is envisaged to target one or more of the RNA targeting CRISPR components to the plant chloroplast. This is achieved by incorporating in the expression construct a sequence encoding a chloroplast transit peptide (CTP) or plastid transit peptide, operably linked to the 5' region of the sequence encoding the RNA targeting protein. The CTP is removed in a processing step during translocation into the chloroplast. Chloroplast targeting of expressed proteins is well known to the skilled artisan (see, for instance, Protein Transport into Chloroplasts, 2010, Annual Review of Plant Biology, Vol. 61: 157-180). In such embodiments, it is also desired to target the one or more guide RNAs to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the RNA targeting-guide RNA(s).

Introduction of Polynucleotides Encoding the CRISPR-RNA Targeting System in Algal Cells Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species using Cas9. Using similar tools, the methods of the RNA targeting CRISPR system described herein can be applied on *Chlamydomonas* species and other algae. In particular embodiments, RNA targeting protein and guide RNA(s) are introduced in algae expressed using a vector that expresses RNA targeting protein under the control of a constitutive promoter such as Hsp70A-Rbc S2 or Beta2-tubulin. Guide RNA is optionally delivered using a vector containing T7 promoter. Alternatively, RNA targeting mRNA and in vitro transcribed guide RNA can be delivered to algal cells. Electroporation protocols are available to the skilled person such as the standard recommended protocol from the GeneArt *Chlamydomonas* Engineering kit.

Introduction of Polynucleotides Encoding RNA Targeting Components in Yeast Cells In particular embodiments, the invention relates to the use of the RNA targeting CRISPR system for RNA editing in yeast cells. Methods for transforming yeast cells which can be used to introduce polynucleotides encoding the RNA targeting CRISPR system components are well known to the artisan and are reviewed by Kawai et al., 2010, Bioeng Bugs. 2010 November-December; 1(6): 395-403). Non-limiting examples include transformation of yeast cells by lithium acetate treatment (which may further include carrier DNA and PEG treatment), bombardment or by electroporation.

Transient Expression of RNA Targeting CRISP System Components in Plants and Plant Cells In particular embodiments, it is envisaged that the guide RNA and/or RNA targeting gene are transiently expressed in the plant cell. In these embodiments, the RNA targeting CRISPR system can ensure modification of RNA target molecules only when both the guide RNA and the RNA targeting protein is present in a cell, such that gene expression can further be controlled. As the expression of the RNA targeting enzyme is transient, plants regenerated from such plant cells typically contain no foreign DNA. In particular embodiments, the RNA targeting enzyme is stably expressed by the plant cell and the guide sequence is transiently expressed.

In particularly preferred embodiments, the RNA targeting CRISPR system components can be introduced in the plant cells using a plant viral vector (Scholthof et al. 1996, Annu Rev Phytopathol. 1996; 34:299-323 and WO 2015189693 which describes the delivery of gRNA using a plant virus vector). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., *Faba* bean necrotic yellow virus). For example, the viral vector may be a pWSRi vector as described in Golenberg et al., Plant Methods, 2009 or a BeYDV vector as described by Chen et al., Human Vaccines, 2011. In other particular embodiments, said viral vector is a vector from an RNA virus. For example, tobravirus (e.g., tobacco rattle virus (TRV), tobacco mosaic virus), potexvirus (e.g., potato virus X), or hordeivirus (e.g., barley stripe mosaic virus). The replicating genomes of plant viruses are non-integrative vectors, which is of interest in the context of avoiding the production of GMO plants.

In particular embodiments, the vector used for transient expression of RNA targeting CRISPR constructs is, for instance, a pEAQ vector, which is tailored for *Agrobacterium*-mediated transient expression (Sainsbury F. et al., Plant Biotechnol J. 2009 September; 7(7):682-93) in the protoplast. Precise targeting of genomic locations was demonstrated using a modified Cabbage Leaf Curl virus (CaLCuV) vector to express gRNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the RNA targeting gene can be transiently introduced into the plant cell. In such embodiments, the introduced double-stranded DNA fragments are provided in sufficient quantity to modify RNA molecule(s) in the cell but do not persist after a contemplated period of time has passed or after one or more cell divisions. Methods for direct DNA transfer in plants are known by the skilled artisan (see, for instance, Davey et al. Plant Mol Biol. 1989 September; 13(3):273-85.)

In other embodiments, an RNA polynucleotide encoding the RNA targeting protein is introduced into the plant cell, which is then translated and processed by the host cell generating the protein in sufficient quantity to modify the RNA molecule(s) cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122). Combinations of the different methods described above are also envisaged.

Delivery of Guide RNA to Plant Cells Comprising a CRISPR Effector Protein

In particular embodiments, it can be of interest to generate plant lines expressing the CRISPR RNA targeting protein, whereby the guide RNA is delivered to the plant cell to direct the RNA targeting protein to the target. In these embodiments, the guide RNA can be delivered by vectors such as those described hereinabove. In particular embodiments, the vector is a plant viral vector, as described in WO2015/189693. In further particular embodiments, the nucleic acid sequence encoding a guide RNA is inserted into the TRV-RNA2 genome of the TRV-derived vector.

Delivery of RNA Targeting CRISPR Components to the Plant Cell

In particular embodiments, it is of interest to deliver one or more components of the RNA targeting CRISPR system directly to the plant cell. This is of interest, inter alia, for the generation of non-transgenic plants (see below). In particular embodiments, one or more of the RNA targeting components is prepared outside the plant or plant cell and delivered to the cell. For instance in particular embodiments, the RNA targeting protein is prepared in vitro prior to introduction to the plant cell. RNA targeting protein can be prepared by various methods known by one of skill in the art and include recombinant production. After expression, the RNA targeting protein is isolated, refolded if needed, purified and optionally treated to remove any purification tags, such as a His-tag. Once crude, partially purified, or more completely purified RNA targeting protein is obtained, the protein may be introduced to the plant cell.

In particular embodiments, the RNA targeting protein is mixed with guide RNA targeting the RNA of interest to form a pre-assembled ribonucleoprotein.

The individual components or pre-assembled ribonucleoprotein can be introduced into the plant cell via electroporation, by bombardment with RNA targeting-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. *Nature Biotechnology*, 2015; DOI: 10.1038/nbt.3389). These methods can be modified to achieve targeted modification of RNA molecules in the plants.

In particular embodiments, the RNA targeting CRISPR system components are introduced into the plant cells using nanoparticles. The components, either as protein or nucleic acid or in a combination thereof, can be uploaded onto or packaged in nanoparticles and applied to the plants (such as, for instance, described in WO 2008042156 and US 20130185823). In particular, embodiments of the invention comprise nanoparticles uploaded with or packed with DNA molecule(s) encoding the RNA targeting protein, DNA molecules encoding the guide RNA and/or isolated guide RNA as described in WO2015089419.

Further means of introducing one or more components of the RNA targeting CRISPR system to the plant cell is by using cell penetrating peptides (CPP). Accordingly, in particular embodiments, the invention comprises compositions comprising a cell penetrating peptide linked to an RNA targeting protein. In particular embodiments of the present invention, an RNA targeting protein and/or guide RNA is coupled to one or more CPPs to effectively transport them inside plant protoplasts (Ramakrishna 2014, Genome Res. 2014 June; 24(6):1020-7 for Cas9 in human cells). In other embodiments, the RNA targeting gene and/or guide RNA(s) are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipatic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing and, hence, facilitate interaction of the biomolecule with the target. Examples of CPP include amongst others: Tat, a nuclear transcriptional activator protein required for viral replication by HIV type1, penetratin, Kaposi fibroblast growth factor (FGF) signal peptide sequence, integrin β3 signal peptide sequence, polyarginine peptide Args sequence, Guanine rich-molecular transporters, sweet arrow peptide, etc.

Target RNA Envisaged for Plant, Algae or Fungal Applications

The target RNA, i.e. the RNA of interest, is the RNA to be targeted by the present invention leading to the recruitment to, and the binding of the RNA targeting protein at the target site of interest on the target RNA. The target RNA may be any suitable form of RNA. This may include, in some embodiments, mRNA. In other embodiments, the target RNA may include transfer RNA (tRNA) or ribosomal RNA (rRNA). In other embodiments, the target RNA may include interfering RNA (RNAi), microRNA (miRNA), microswitches, microzymes, satellite RNAs and RNA viruses. The target RNA may be located in the cytoplasm of the plant cell, or in the cell nucleus or in a plant cell organelle such as a mitochondrion, chloroplast or plastid.

In preferred embodiments, the target RNA is a plant mRNA encoded by a resistance or by a susceptibility gene. The terms "resistance gene," "disease resistance gene" and "R gene" are used interchangeably herein to denote a gene encoding a polypeptide capable of mediating or contributing to resistance to a specific plant pathogen. A "plant pathogen" is a disease-causing organism which attacks plants, a "disease" being any deviation from normal functioning of physiological processes of sufficient duration to cause disturbance or cessation of vitality. There are numerous types of pathogens which can target plants, including fungal pathogens, oomycetes, bacteria, viruses and viroids. The polypeptide encoded by the resistance gene may, for example, mediate resistance to a specific pathogen by triggering a defense response to said pathogen in a plant cell or plant tissue. A defense response is an active defensive reaction by a host, e.g. a plant, that stops or limits the growth and/or spread of the pathogen. The resulting resistance can be characterized by an absence or reduction in symptoms that would be present on inoculated plant tissue in the absence of such a response and/or by the pathogen being unable to complete its life cycle and/or to multiply or spread. A polypeptide encoded by a resistance gene may, for example, mediate the recognition of specific pathogen effectors, which are usually encoded by the pathogens avirulence (Avr) genes, either by directly binding thereto or by recognizing an alteration in a host protein that is caused by the pathogen. A plant carrying a specific resistance gene is, therefore, effectively protected from a pathogen carrying the corresponding avirulence gene. Resistance genes for different pathogens in different plants have been identified and are known in the art. A database providing an overview of resistance genes (R-genes) in plants can be found, for example at http://www.prgdb.org (see Sanseverino et al, 2010 Nucleic Acids Res).

A "susceptibility gene" or "S gene" is a plant gene encoding a product that is exploited by a pathogen during infection and colonization of the plant. A product encoded by a susceptibility gene may, for example, facilitate entry and/or growth of the pathogen. Based on the mechanism, S-genes have been divided into three classes (van Schie and Takken, Annu Rev Phytopathol., 2014). The first class comprises the genes required in early pathogen establishment, i.e. in early pathogen infection steps. The second class of S-genes encodes modulators of host defenses, in particular negative regulators of plant immunity. The third class of S-genes includes genes involved in pathogen sustenance, i.e. substrates essential for the pathogen, such as metabolite biosynthesis and sugar transport. When a susceptibility gene becomes disabled, this may cause a resistance phenotype resembling that of healthy plants. Therefore, by reducing the expression of a susceptibility gene, a durable and broad-spectrum resistance can be achieved. Susceptibility genes for different pathogens in different plants have been identified and are known in the art. For example, translation initiation factors, such as eIF(iso)4E and eIF4E have been described to be required for viral survival and Mildew resistance locus (MLO) proteins appear to be relevant in susceptibility to powdery mildew, at least in bread wheat.

In particular embodiments, the RNA targeting CRISPR system is used to cleave RNA or otherwise inhibit RNA expression.

Use of RNA Targeting CRISPR System for Modulating Plant Gene Expression Via RNA Modulation The RNA targeting protein may also be used, together with a suitable guide RNA, to target gene expression, via control of RNA processing. The control of RNA processing may include RNA processing reactions such as RNA splicing, including alternative splicing or specifically targeting certain splice variants or isoforms; viral replication (in particular of plant viruses, including virioids in plants and tRNA biosynthesis. The RNA targeting protein in combination with a suitable guide RNA may also be used to control RNA activation (RNAa). RNAa leads to the promotion of gene expression, so control of gene expression may be achieved that way through disruption or reduction of RNAa and thus less promotion of gene expression.

The RNA targeting effector protein of the invention can further be used for antiviral activity in plants, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. Provided therefore is the use of an RNA targeting effector protein of the invention as an antiviral agent. Examples of viruses that can be counteracted in this way include, but are not limited to, Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), *Citrus tristeza* virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis* mosaic virus (ArMV), or *Rupestris* stem pitting-associated virus (RSPaV). Also DNA viruses replicating via a RNA intermediate and RNA viruses replicating via a DNA intermediate (RT-viruses) may be targeted. This includes, for example, the Cauliflower mosaic virus (CaMV) and Tomato yellow leaf curl virus (TYLCV). Further, RNA transcribed from the genome of DNA viruses may also be targeted and, for example, cleaved by the CRISPR system of the invention.

Examples of modulating RNA expression in plants, algae or fungi, as an alternative of targeted gene modification are described herein further.

Of particular interest is the regulated control of gene expression through regulated cleavage of mRNA. This can be achieved by placing elements of the RNA targeting under the control of regulated promoters as described herein.

Use of the RNA Targeting CRISPR System to Restore the Functionality of tRNA Molecules Pring et al. describe RNA editing in plant mitochondria and chloroplasts that alters mRNA sequences to code for different proteins than the DNA. (Plant Mol. Biol. (1993) 21 (6): 1163-1170. doi:10.1007/BF00023611). In particular embodiments of the invention, the elements of the RNA targeting CRISPR system specifically targeting mitochondrial and chloroplast mRNA can be introduced in a plant or plant cell to express different proteins in such plant cell organelles mimicking the processes occurring in vivo.

Use of the RNA Targeting CRISPR System as an Alternative to RNA Interference to Inhibit RNA Expression The RNA targeting CRISPR system has uses similar to RNA inhibition or RNA interference, thus can also be substituted for such methods. In particular embodiments, the methods of the present invention include the use of the RNA targeting CRISPR as a substitute for e.g. an interfering ribonucleic acid (such as an siRNA or shRNA or a dsRNA). Examples of inhibition of RNA expression in plants, algae or fungi as an alternative of targeted gene modification are described herein further.

Use of the RNA Targeting CRISPR System to Control RNA Interference

Control over interfering RNA or miRNA may help reduce off-target effects (OTE) seen with those approaches by reducing the longevity of the interfering RNA or miRNA in vivo or in vitro. In particular embodiments, the target RNA may include interfering RNA, i.e. RNA involved in an RNA interference pathway, such as shRNA, siRNA and so forth.

In other embodiments, the target RNA may include microRNA (miRNA) or double stranded RNA (dsRNA).

In other particular embodiments, if the RNA targeting protein and suitable guide RNA(s) are selectively expressed (for example spatially or temporally under the control of a regulated promoter, for example a tissue- or cell cycle-specific promoter and/or enhancer) this can be used to 'protect' the cells or systems (in vivo or in vitro) from RNAi in those cells. This may be useful in neighboring tissues or cells where RNAi is not required or for the purposes of comparison of the cells or tissues where the effector protein and suitable guide are and are not expressed (i.e. where the RNAi is not controlled and where it is, respectively). The RNA targeting protein may be used to control or bind to molecules comprising or consisting of RNA, such as ribozymes, ribosomes or riboswitches. In embodiments of the invention, the guide RNA can recruit the RNA targeting protein to these molecules so that the RNA targeting protein is able to bind to them.

The RNA targeting CRISPR system of the invention can be applied in areas of in-planta RNAi technologies, without undue experimentation, from this disclosure, including insect pest management, plant disease management and management of herbicide resistance, as well as in plant assay and for other applications (see, for instance Kim et al., in Pesticide Biochemistry and Physiology (Impact Factor: 2.01). January 2015; 120. DOI: 10.1016/j.pestbp.2015.01.002; Sharma et al. in Academic Journals (2015), Vol. 12(18) pp2303-2312); Green J. M, in Pest Management Science, Vol 70(9), pp 1351-1357), because the present application provides the foundation for informed engineering of the system.

Use of RNA Targeting CRISPR System to Modify Riboswitches and Control Metabolic Regulation in Plants, Algae and Fungi Riboswitches (also known as aptozymes) are regulatory segments of messenger RNA that bind small molecules and in turn regulate gene expression. This mechanism allows the cell to sense the intracellular concentration of these small molecules. A particular riboswitch typically regulates its adjacent gene by altering the transcription, the translation or the splicing of this gene. Thus, in particular embodiments of the present invention, control of riboswitch activity is envisaged through the use of the RNA targeting protein in combination with a suitable guide RNA to target the riboswitch. This may be through cleavage of, or binding to, the riboswitch. In particular embodiments, reduction of riboswitch activity is envisaged. Recently, a riboswitch that binds thiamin pyrophosphate (TPP) was characterized and found to regulate thiamin biosynthesis in plants and algae. Furthermore it appears that this element is an essential regulator of primary metabolism in plants (Bocobza and Aharoni, Plant J. 2014 August; 79(4):693-703. doi: 10.1111/tpj.12540. Epub 2014 Jun. 17). TPP riboswitches are also found in certain fungi, such as in *Neurospora crassa*, where it controls alternative splicing to conditionally produce an Upstream Open Reading Frame (uORF), thereby affecting the expression of downstream genes (Cheah M T et al., (2007) Nature 447 (7143): 497-500. doi:10.1038/nature05769). The RNA targeting CRISPR system described herein may be used to manipulate the endogenous riboswitch activity in plants, algae or fungi and as such alter the expression of downstream genes controlled by it. In particular embodiments, the RNA targeting CRISP system may be used in assaying riboswitch function in vivo or in vitro and in studying its relevance for the metabolic network. In particular embodiments, the RNA targeting CRISPR system may potentially be used for engineering of riboswitches as metabolite sensors in plants and platforms for gene control.

Use of RNA Targeting CRISPR System in RNAi Screens for Plants, Algae or Fungi

Identifying gene products whose knockdown is associated with phenotypic changes, biological pathways can be interrogated and the constituent parts identified, via RNAi screens. In particular embodiments of the invention, control may also be exerted over or during these screens by use of the Guide 29 or Guide 30 protein and suitable guide RNA described herein to remove or reduce the activity of the RNAi in the screen and thus reinstate the activity of the (previously interfered with) gene product (by removing or reducing the interference/repression).

Use of RNA Targeting Proteins for Visualization of RNA Molecules In Vivo and In Vitro In particular embodiments, the invention provides a nucleic acid binding system. In situ hybridization of RNA with complementary probes is a powerful technique. Typically, fluorescent DNA oligonucleotides are used to detect nucleic acids by hybridization. Increased efficiency has been attained by certain modifications, such as locked nucleic acids (LNAs), but there remains a need for efficient and versatile alternatives. As such, labelled elements of the RNA targeting system can be used as an alternative for efficient and adaptable system for in situ hybridization.

Further Applications of the RNA Targeting CRISPR System in Plants and Yeasts

Use of RNA Targeting CRISPR System in Biofuel Production

The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the RNA targeting CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488).

Modifying Yeast for Biofuel Production

In particular embodiments, the RNA targeting enzyme provided herein is used for bioethanol production by recombinant micro-organisms. For instance, RNA targeting enzymes can be used to engineer micro-organisms, such as yeast, to generate biofuel or biopolymers from fermentable sugars and optionally to be able to degrade plant-derived lignocellulose derived from agricultural waste as a source of fermentable sugars. More particularly, the invention provides methods whereby the RNA targeting CRISPR complex is used to modify the expression of endogenous genes required for biofuel production and/or to modify endogenous genes that may interfere with the biofuel synthesis. More particularly, the methods involve stimulating the expression in a micro-organism such as a yeast of one or more nucleotide sequence encoding enzymes involved in the conversion of pyruvate to ethanol or another product of interest. In particular embodiments, the methods ensure the stimulation of expression of one or more enzymes which allows the micro-organism to degrade cellulose, such as a cellulase. In yet further embodiments, the RNA targeting CRISPR complex is used to suppress endogenous metabolic pathways which compete with the biofuel production pathway.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species using Cas9. Using similar tools, the methods of the RNA targeting CRISPR system described herein can be applied on *Chlamydomonas* species and other algae. In particular embodiments, the RNA targeting effector protein and guide RNA are introduced in algae expressed using a vector that expresses the RNA targeting effector protein under the control of a constitutive promoter such as Hsp70A-Rbc S2 or Beta2-tubulin. Guide RNA will be delivered using a vector containing T7 promoter. Alternatively, in vitro transcribed guide RNA can be delivered to algae cells. Electroporation protocol follows standard recommended protocol from the GeneArt *Chlamydomonas* Engineering kit.

Particular Applications of the RNA Targeting Enzymes in Plants

In particular embodiments, present invention can be used as a therapy for virus removal in plant systems as it is able to cleave viral RNA. Previous studies in human systems have demonstrated the success of utilizing CRISPR in targeting the single strand RNA virus, hepatitis C (A. Price, et al., Proc. Natl. Acad. Sci, 2015). These methods may also be adapted for using the RNA targeting CRISPR system in plants.

Improved Plants

The present invention also provides plants and yeast cells obtainable and obtained by the methods provided herein. The improved plants obtained by the methods described herein may be useful in food or feed production through the modified expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

In an embodiment of the invention, a CRISPR system is used to engineer pathogen resistant plants, for example, by creating resistance against diseases caused by bacteria, fungi or viruses. In certain embodiments, pathogen resistance can be accomplished by engineering crops to produce a CRISPR system that will be ingested by an insect pest, leading to mortality. In an embodiment of the invention, a CRISPR system is used to engineer abiotic stress tolerance. In another embodiment, a CRISPR system is used to engineer drought stress tolerance or salt stress tolerance, or cold or heat stress tolerance. Younis et al. 2014, Int. J. Biol. Sci. 10; 1150 reviewed potential targets of plant breeding methods, all of which are amenable to correction or improvement through use of a CRISPR system described herein. Preferably, the effector protein of the CRISPR system is a C2c2 effector protein. Some non-limiting target crops include *Arabidops thaliana, Oryza sativa* L, *Prunus domestica* L., *Gossypium hirsutum, Nicotiana rustica, Zea mays, Medicago sativa, Nicotiana benthamiana* and *Arabidopsis thaliana*.

In an embodiment of the invention, a CRISPR system is used for management of crop pests. For example, a CRISPR system operable in a crop pest can be expressed from a plant host or transferred directly to the target, for example, using a viral vector. Preferably, the effector protein of the CRISPR system is a C2c2 effector protein. In a particularly preferred embodiment of the invention, the plant is rice (e.g. *Oryza sativa*) and the CRISPR effector protein is selected from *Leptotrichia wadei* C2c2 (Lw2) and Lachnospiraceae bacterium MA2020 C2c2 (LbM).

Application of the C2C2 Proteins in Optimized Functional RNA Targeting Systems

In an aspect, the invention provides a system for specific delivery of functional components to the RNA environment. This can be ensured using the CRISPR systems comprising the RNA targeting effector proteins of the present invention which allow specific targeting of different components to RNA. More particularly, such components include activators or repressors, such as activators or repressors of RNA translation, degradation, etc. Applications of this system are described elsewhere herein.

According to one aspect, the invention provides non-naturally occurring or engineered composition comprising a guide RNA comprising a guide sequence capable of hybridizing to a target sequence (in vitro, in vivo, or ex vivo), wherein the guide RNA is modified by the insertion of one or more distinct RNA sequence(s) that bind an adaptor protein. In particular embodiments, the RNA sequences may bind to two or more adaptor proteins (e.g. aptamers), and wherein each adaptor protein is associated with one or more functional domains. The guide RNAs of the C2c2 enzymes described herein are amenable to modification of the guide sequence. In particular embodiments, the guide RNA is modified by the insertion of distinct RNA sequence(s) 5' of the direct repeat, within the direct repeat, or 3' of the guide sequence. When there is more than one functional domain, the functional domains can be the same or different, e.g., two of the same or two different activators or repressors. In an aspect, the invention provides a herein-discussed composition, wherein the one or more functional domains are attached to the RNA targeting enzyme so that upon binding to the target RNA the functional domain is in a spatial orientation allowing for the functional domain to function in its attributed function. In an aspect, the invention provides a herein-discussed composition, wherein the composition comprises a CRISPR-Cas complex having at least three functional domains, at least one of which is associated with the RNA targeting enzyme and at least two of which are associated with the gRNA.

Accordingly, in an aspect, the invention provides non-naturally occurring or engineered CRISPR-Cas complex composition comprising the guide RNA as herein-discussed and a CRISPR enzyme which is an RNA targeting enzyme, wherein optionally the RNA targeting enzyme comprises at least one mutation, such that the RNA targeting enzyme has no more than 5% of the nuclease activity of the enzyme not having the at least one mutation, and optionally one or more comprising at least one or more nuclear localization sequences. In particular embodiments, the guide RNA is additionally or alternatively modified so as to still ensure binding of the RNA targeting enzyme but to prevent cleavage by the RNA targeting enzyme (as detailed elsewhere herein).

In particular embodiments, the RNA targeting enzyme is a CRISPR effector protein which has a diminished nuclease activity of at least 97%, or 100% as compared with the CRISPR effector protein not having the at least one mutation. In an aspect, the invention provides a herein-discussed composition, wherein the CRISPR effector protein comprises two or more mutations. Preferably, the CRISPR effector protein is a C2c2 effector protein. In that case, the mutations may be selected from mutations of one or more of the following amino acid residues: R597, H602, R1278, and H1283, such as for instance one or more of the following mutations: R597A, H602A, R1278A, and H1283A, according to *Leptotrichia shahii* C2c2 protein or a corresponding position in an ortholog.

In particular embodiments, an RNA targeting system is provided as described herein above comprising two or more functional domains. In particular embodiments, the two or more functional domains are heterologous functional domains. In particular embodiments, the system comprises an adaptor protein which is a fusion protein comprising a functional domain, the fusion protein optionally comprising a linker between the adaptor protein and the functional domain. In particular embodiments, the linker includes a GlySer linker. Additionally or alternatively, one or more functional domains are attached to the RNA effector protein by way of a linker, optionally a GlySer linker. In particular embodiments, the one or more functional domains are attached to the RNA targeting enzyme through one or both of the HEPN domains.

In an aspect, the invention provides a herein-discussed composition, wherein the one or more functional domains associated with the adaptor protein or the RNA targeting enzyme is a domain capable of activating or repressing RNA translation. In an aspect, the invention provides a herein-discussed composition, wherein at least one of the one or more functional domains associated with the adaptor protein have one or more activities comprising methylase activity, demethylase activity, transcription activation activity, transcription repression activity, transcription release factor activity, histone modification activity, DNA integration activity RNA cleavage activity, DNA cleavage activity or nucleic acid binding activity, or molecular switch activity or chemical inducibility or light inducibility.

In an aspect, the invention provides a herein-discussed composition comprising an aptamer sequence. In particular embodiments, the aptamer sequence is two or more aptamer sequences specific to the same adaptor protein. In an aspect, the invention provides a herein-discussed composition, wherein the aptamer sequence is two or more aptamer sequences specific to different adaptor protein. In an aspect, the invention provides a herein-discussed composition, wherein the adaptor protein comprises MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, PRR1. Accordingly, in particular embodiments, the aptamer is selected from a binding protein specifically binding any one of the adaptor proteins listed above. In an aspect, the invention provides a herein-discussed composition, wherein the cell is a eukaryotic cell. In an aspect, the invention provides a herein-discussed composition, wherein the eukaryotic cell is a plant cell.

In an aspect, the invention provides a herein above-discussed composition wherein there is more than one gRNA, and the gRNAs target different sequences whereby when the composition is employed, there is multiplexing. In an aspect, the invention provides a composition wherein there is more than one gRNA modified by the insertion of distinct RNA sequence(s) that bind to one or more adaptor proteins.

In an aspect, the invention provides a herein-discussed composition wherein one or more adaptor proteins associated with one or more functional domains is present and bound to the distinct RNA sequence(s) inserted into the guide RNA(s).

In an aspect, the invention provides a herein-discussed composition wherein the guide RNA is modified to have at least one non-coding functional loop; e.g., wherein the at least one non-coding functional loop is repressive; for instance, wherein at least one non-coding functional loop comprises Alu.

In an aspect, the invention provides a method for modifying gene expression comprising the administration to a host or expression in a host in vivo of one or more of the compositions as herein-discussed.

In an aspect, the invention provides a herein-discussed method comprising the delivery of the composition or nucleic acid molecule(s) coding therefor, wherein said nucleic acid molecule(s) are operatively linked to regulatory sequence(s) and expressed in vivo. In an aspect the invention provides a herein-discussed method wherein the expression in vivo is via a plant viral vector as described herein.

In an aspect, the invention provides a plant cell line of cells as herein-discussed. In an aspect, the invention provides a transgenic plant model wherein the model has been transformed with a herein-discussed composition or is a progeny of said transformant.

In an aspect, the invention provides a nucleic acid molecule(s) encoding guide RNA or the RNA targeting CRISPR-Cas complex or the composition as herein-discussed. In an aspect, the invention provides a vector comprising: a nucleic acid molecule encoding a guide RNA (gRNA) comprising a guide sequence capable of hybridizing to a target sequence in a genomic locus of interest in a cell, wherein the direct repeat of the gRNA is modified by the insertion of distinct RNA sequence(s) that bind(s) to two or more adaptor proteins, and wherein each adaptor protein is associated with one or more functional domains; or, wherein the gRNA is modified to have at least one non-coding functional loop. In an aspect, the invention provides vector(s) comprising nucleic acid molecule(s) encoding: non-naturally occurring or engineered CRISPR-Cas complex composition comprising the gRNA herein-discussed, and an RNA targeting enzyme, wherein optionally the RNA targeting enzyme comprises at least one mutation, such that the RNA targeting enzyme has no more than 5% of the nuclease activity of the RNA targeting enzyme not having the at least one mutation, and optionally one or more comprising at least one or more nuclear localization sequences. In an aspect, a vector can further comprise regulatory element(s) operable in a eukaryotic cell operably linked to the nucleic acid molecule encoding the guide RNA (gRNA) and/or the nucleic acid molecule encoding the RNA targeting enzyme and/or the optional nuclear localization sequence(s).

In one aspect, the invention provides a kit comprising one or more of the components described hereinabove. In some embodiments, the kit comprises a vector system as described above and instructions for using the kit.

In an aspect, the invention provides a method of screening for gain of function (GOF) or loss of function (LOF) or for screening non-coding RNAs or potential regulatory regions (e.g. enhancers, repressors) comprising the cell line of as herein-discussed or cells of the model herein-discussed containing or expressing the RNA targeting enzyme and introducing a composition as herein-discussed into cells of the cell line or model, whereby the gRNA includes either an activator or a repressor, and monitoring for GOF or LOF respectively as to those cells as to which the introduced gRNA includes an activator or as to those cells as to which the introduced gRNA includes a repressor.

In an aspect, the invention provides a library of non-naturally occurring or engineered compositions, each comprising a RNA targeting CRISPR guide RNA (gRNA) comprising a guide sequence capable of hybridizing to a target RNA sequence of interest in a cell, an RNA targeting enzyme, wherein the RNA targeting enzyme comprises at least one mutation, such that the RNA targeting enzyme has no more than 5% of the nuclease activity of the RNA targeting enzyme not having the at least one mutation, wherein the gRNA is modified by the insertion of distinct RNA sequence(s) that bind to one or more adaptor proteins, and wherein the adaptor protein is associated with one or more functional domains, wherein the composition comprises one or more or two or more adaptor proteins, wherein the each protein is associated with one or more functional domains, and wherein the gRNAs comprise a genome wide library comprising a plurality of RNA targeting guide RNAs (gRNAs). In an aspect, the invention provides a library as herein-discussed, wherein the RNA targeting RNA targeting enzyme has a diminished nuclease activity of at least 97%, or 100% as compared with the RNA targeting enzyme not having the at least one mutation. In an aspect, the invention provides a library as herein-discussed, wherein the adaptor protein is a fusion protein comprising the functional domain. In an aspect, the invention provides a library as herein discussed, wherein the gRNA is not modified by the insertion of distinct RNA sequence(s) that bind to the one or two or more adaptor proteins. In an aspect, the invention provides a library as herein discussed, wherein the one or two or more functional domains are associated with the RNA targeting enzyme. In an aspect, the invention provides a library as herein discussed, wherein the cell population of cells is a population of eukaryotic cells. In an aspect, the invention provides a library as herein discussed, wherein the eukaryotic cell is a plant cell or a yeast cell.

In an aspect, the invention provides a library as herein discussed, wherein the targeting is of about 100 or more RNA sequences. In an aspect, the invention provides a library as herein discussed, wherein the targeting is of about 1000 or more RNA sequences. In an aspect, the invention provides a library as herein discussed, wherein the targeting is of about 20,000 or more sequences. In an aspect, the invention provides a library as herein discussed, wherein the targeting is of the entire transcriptome. In an aspect, the invention provides a library as herein discussed, wherein the targeting is of a panel of target sequences focused on a relevant or desirable pathway. In an aspect, the invention provides a library as herein discussed, wherein the pathway is an immune pathway. In an aspect, the invention provides a library as herein discussed, wherein the pathway is a cell division pathway.

In one aspect, the invention provides a method of generating a model eukaryotic cell comprising a gene with modified expression. In some embodiments, a disease gene is any gene associated with an increase in the risk of having or developing a disease. In some embodiments, the method comprises (a) introducing one or more vectors encoding the components of the system described herein above into a eukaryotic cell, and (b) allowing a CRISPR complex to bind to a target polynucleotide so as to modify expression of a gene, thereby generating a model eukaryotic cell comprising modified gene expression.

The structural information provided herein allows for interrogation of guide RNA interaction with the target RNA and the RNA targeting enzyme permitting engineering or alteration of guide RNA structure to optimize functionality of the entire RNA targeting CRISPR-Cas system. For example, the guide RNA may be extended, without colliding with the RNA targeting protein by the insertion of adaptor proteins that can bind to RNA. These adaptor proteins can further recruit effector proteins or fusions which comprise one or more functional domains.

An aspect of the invention is that the above elements are comprised in a single composition or comprised in individual compositions. These compositions may advantageously be applied to a host to elicit a functional effect on the transciptome level.

The skilled person will understand that modifications to the guide RNA which allow for binding of the adapter+ functional domain but not proper positioning of the adapter+ functional domain (e.g. due to steric hindrance within the three dimensional structure of the CRISPR complex) are modifications which are not intended. The one or more modified guide RNA may be modified, by introduction of a distinct RNA sequence(s) 5' of the direct repeat, within the direct repeat, or 3' of the guide sequence.

The modified guide RNA, the inactivated RNA targeting enzyme (with or without functional domains), and the binding protein with one or more functional domains, may each individually be comprised in a composition and administered to a host individually or collectively. Alternatively, these components may be provided in a single composition for administration to a host. Administration to a host may be performed via viral vectors known to the skilled person or described herein for delivery to a host (e.g. geminiviral vectors). As explained herein, use of different selection markers (e.g. for gRNA selection) and concentration of gRNA (e.g. dependent on whether multiple gRNAs are used) may be advantageous for eliciting an improved effect.

Using the provided compositions, the person skilled in the art can advantageously and specifically target single or multiple loci with the same or different functional domains to elicit one or more events on the RNA level. The compositions may be applied in a wide variety of methods for screening in libraries in cells and functional modeling in vivo (e.g. gene activation of lincRNA and identification of function; gain-of-function modeling; loss-of-function modeling; the use the compositions of the invention to establish cell lines and transgenic plants for optimization and screening purposes).

The current invention comprehends the use of the compositions of the current invention to establish and utilize conditional or inducible CRISPR RNA targeting events. (See, e.g., Platt et al., Cell (2014), http://dx.doi.org/10.1016/j.cell.2014.09.014, or PCT patent publications cited herein, such as WO 2014/093622 (PCT/US2013/074667), which are not believed prior to the present invention or application). For example, the target cell comprises RNA targeting CRISRP enzyme conditionally or inducibly (e.g. in the form of Cre dependent constructs) and/or the adapter protein conditionally or inducibly and, on expression of a vector introduced into the target cell, the vector expresses that which induces or gives rise to the condition of RNA targeting enzyme expression and/or adaptor expression in the target cell. By applying the teaching and compositions of the current invention with the known method of creating a CRISPR complex, inducible gene expression affected by functional domains are also an aspect of the current invention. Alternatively, the adaptor protein may be provided as a conditional or inducible element with a conditional or inducible RNA targeting enzyme to provide an effective model for screening purposes, which advantageously only requires minimal design and administration of specific gRNAs for a broad number of applications.

Guide RNA According to the Invention Comprising a Dead Guide Sequence

In one aspect, the invention provides guide sequences which are modified in a manner which allows for formation of the CRISPR complex and successful binding to the target, while at the same time, not allowing for successful nuclease activity (i.e. without nuclease activity). For matters of explanation, such modified guide sequences are referred to as "dead guides" or "dead guide sequences". These dead guides or dead guide sequences can be thought of as catalytically inactive or conformationally inactive with regard to nuclease activity. Indeed, dead guide sequences may not sufficiently engage in productive base pairing with respect to the ability to promote catalytic activity or to distinguish on-target and off-target binding activity. Briefly, the assay involves synthesizing a CRISPR target RNA and guide RNAs comprising mismatches with the target RNA, combining these with the RNA targeting enzyme and analyzing cleavage based on gels based on the presence of bands generated by cleavage products, and quantifying cleavage based upon relative band intensities.

Hence, in a related aspect, the invention provides a non-naturally occurring or engineered composition RNA targeting CRISPR-Cas system comprising a functional CRISPR effector protein as described herein, and guide RNA (gRNA) wherein the gRNA comprises a dead guide sequence whereby the gRNA is capable of hybridizing to a target sequence such that the RNA targeting CRISPR-Cas system is directed to a target RNA a cell without detectable RNA cleavage activity. It is to be understood that any of the gRNAs according to the invention as described herein elsewhere may be used as dead gRNAs/gRNAs comprising a dead guide sequence as described herein below. Any of the methods, products, compositions and uses as described herein elsewhere is equally applicable with the dead gRNAs/gRNAs comprising a dead guide sequence as further detailed below. By means of further guidance, the following particular aspects and embodiments are provided.

The ability of a dead guide sequence to direct sequence-specific binding of a CRISPR complex to an RNA target sequence may be assessed by any suitable assay. For example, the components of a CRISPR system sufficient to form a CRISPR complex, including the dead guide sequence to be tested, may be provided to a host cell having the corresponding target sequence, such as by transfection with vectors encoding the components of the CRISPR sequence, followed by an assessment of preferential cleavage within the target sequence. For instance, cleavage of a target RNA polynucleotide sequence may be evaluated in a test tube by providing the target sequence, components of a CRISPR complex, including the dead guide sequence to be tested and a control guide sequence different from the test dead guide sequence, and comparing binding or rate of cleavage at the target sequence between the test and control guide sequence reactions. Other assays are possible, and will occur to those skilled in the art. A dead guide sequence may be selected to target any target sequence. In some embodiments, the target sequence is a sequence within an RNA-genome of a plant pathogen or within a target RNA in a cell.

As explained further herein, several structural parameters allow for a proper framework to arrive at such dead guides. Dead guide sequences are typically shorter than respective guide sequences which result in active RNA cleavage. In particular embodiments, dead guides are 5%, 10%, 20%, 30%, 40%, 50%, shorter than respective guides directed to the same.

As explained below and known in the art, one aspect of gRNA-RNA targeting specificity is the direct repeat sequence, which is to be appropriately linked to such guides. In particular, this implies that the direct repeat sequences are designed dependent on the origin of the RNA targeting enzyme. Thus, structural data available for validated dead guide sequences may be used for designing equivalents specific for the CRISPR effector protein, e.g. C2c2. Structural similarity between, e.g., the orthologous nuclease domains HEPN of two or more C2c2 effector proteins may be used to transfer design equivalent dead guides. Thus, the dead guide herein may be appropriately modified in length and sequence to reflect such C2c2 specific equivalents, allowing for formation of the CRISPR complex and successful binding to the target RNA, while at the same time, not allowing for successful nuclease activity.

The use of dead guides in the context herein as well as the state of the art provides a surprising and unexpected platform for network biology and/or systems biology in both in vitro, ex vivo, and in vivo applications, allowing for multiplex gene targeting, and in particular bidirectional multiplex gene targeting. Prior to the use of dead guides, addressing multiple targets has been challenging and in some cases not possible. With the use of dead guides, multiple targets, and thus multiple activities, may be addressed, for example, in the same cell or in the same plant. Such multiplexing may occur at the same time or staggered for a desired timeframe.

For example, the dead guides allow to use gRNA as a means for gene targeting, without the consequence of nuclease activity, while at the same time providing directed means for activation or repression. Guide RNA comprising a dead guide may be modified to further include elements in a manner which allow for activation or repression of gene activity, in particular protein adaptors (e.g. aptamers) as described herein elsewhere allowing for functional placement of gene effectors (e.g. activators or repressors of gene activity). One example is the incorporation of aptamers, as explained herein and in the state of the art. By engineering the gRNA comprising a dead guide to incorporate protein-interacting aptamers (Konermann et al., "Genome-scale transcription activation by an engineered CRISPR-Cas9 complex," doi:10.1038/nature14136, incorporated herein by reference), one may assemble multiple distinct effector domains. Such may be modeled after natural processes.

Thus, one aspect is a gRNA of the invention which comprises a dead guide, wherein the gRNA further comprises modifications which provide for gene activation or repression, as described herein. The dead gRNA may comprise one or more aptamers. The aptamers may be specific to gene effectors, gene activators or gene repressors. Alternatively, the aptamers may be specific to a protein which in turn is specific to and recruits/binds a specific gene effector, gene activator or gene repressor. If there are multiple sites for activator or repressor recruitment, it is preferred that the sites are specific to either activators or repressors. If there are multiple sites for activator or repressor binding, the sites may be specific to the same activators or same repressors. The sites may also be specific to different activators or different repressors. The effectors, activators, repressors may be present in the form of fusion proteins.

In an aspect, the invention provides a method of selecting a dead guide RNA targeting sequence for directing a functionalized CRISPR system to a gene locus in an organism, which comprises: a) locating one or more CRISPR motifs in the gene locus; b) analyzing the 20 nt sequence downstream of each CRISPR motif by: i) determining the GC content of the sequence; and ii) determining whether there are off-target matches of the first 15 nt of the sequence in the genome of the organism; c) selecting the sequence for use in a guide RNA if the GC content of the sequence is 70% or less and no off-target matches are identified. In an embodiment, the sequence is selected if the GC content is 50% or less. In an embodiment, the sequence is selected if the GC content is 40% or less. In an embodiment, the sequence is selected if the GC content is 30% or less. In an embodiment, two or more sequences are analyzed and the sequence having the lowest GC content is selected. In an embodiment, off-target matches are determined in regulatory sequences of the organism. In an embodiment, the gene locus is a regulatory region. An aspect provides a dead guide RNA comprising the targeting sequence selected according to the aforementioned methods.

In an aspect, the invention provides a dead guide RNA for targeting a functionalized CRISPR system to a gene locus in an organism. In an embodiment of the invention, the dead guide RNA comprises a targeting sequence wherein the CG content of the target sequence is 70% or less, and the first 15 nt of the targeting sequence does not match an off-target sequence downstream from a CRISPR motif in the regulatory sequence of another gene locus in the organism. In certain embodiments, the GC content of the targeting sequence 60% or less, 55% or less, 50% or less, 45% or less, 40% or less, 35% or less or 30% or less. In certain embodiments, the GC content of the targeting sequence is from 70% to 60% or from 60% to 50% or from 50% to 40% or from 40% to 30%. In an embodiment, the targeting sequence has the lowest CG content among potential targeting sequences of the locus.

In an embodiment of the invention, the first 15 nt of the dead guide match the target sequence. In another embodiment, first 14 nt of the dead guide match the target sequence. In another embodiment, the first 13 nt of the dead guide match the target sequence. In another embodiment first 12 nt of the dead guide match the target sequence. In another embodiment, first 11 nt of the dead guide match the target sequence. In another embodiment, the first 10 nt of the dead guide match the target sequence. In an embodiment of the invention the first 15 nt of the dead guide does not match an off-target sequence downstream from a CRISPR motif in the regulatory region of another gene locus. In other embodiments, the first 14 nt, or the first 13 nt of the dead guide, or the first 12 nt of the guide, or the first 11 nt of the dead guide, or the first 10 nt of the dead guide, does not match an off-target sequence downstream from a CRISPR motif in the regulatory region of another gene locus. In other embodiments, the first 15 nt, or 14 nt, or 13 nt, or 12 nt, or 11 nt of the dead guide do not match an off-target sequence downstream from a CRISPR motif in the genome.

In certain embodiments, the dead guide RNA includes additional nucleotides at the 3'-end that do not match the target sequence. Thus, a dead guide RNA that includes the first 20-28 nt, downstream of a CRISPR motif can be extended in length at the 3' end.

General Provisions

In an aspect, the invention provides a nucleic acid binding system. In situ hybridization of RNA with complementary probes is a powerful technique. Typically, fluorescent DNA oligonucleotides are used to detect nucleic acids by hybridization. Increased efficiency has been attained by certain modifications, such as locked nucleic acids (LNAs), but there remains a need for efficient and versatile alternatives. The invention provides an efficient and adaptable system for in situ hybridization.

In embodiments of the invention, the terms guide sequence and guide RNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A CRISPR effector protein that is functional in a specific cell or plant may be selected in the same manner. A guide sequence may be selected to target any target sequence. In some embodiments, the target sequence is a sequence within a target RNA of a cell. Exemplary target sequences include those that are unique in the cell.

In general, and throughout this specification, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., geminiviral vectors or vectors based on tobacco mosaic virus (TMV), potato virus X (PVX), alfalfa mosaic virus (AMV) and cucumber mosaic virus (CMV)). Viral vectors also include polynucleotides carried by a virus for transfection into a host cell. Certain vectors are capable of autonomous replication in a host cell into which they are introduced (e.g., bacterial vectors having a bacterial origin of replication). Other vectors are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors."

Common expression vectors of utility in recombinant DNA techniques are often in the form of plasmids. In a preferred embodiment, vectors for expressing the CRISPR effector protein and the gRNA, for example as described in the Examples, can be combined via golden gate cloning and put into *Agrobacterium* vectors (based off pCAMBIA) for whole plant transformation or basic expression vectors for protoplasts.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell).

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as for example leaves, stem or roots, or particular cell types. Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Advantageous vectors include geminiviral viruses, and types of such vectors can also be selected for targeting particular types of cells.

As used herein, the term "crRNA" or "guide RNA" or "single guide RNA" or "sgRNA" or "one or more nucleic acid components" of a Type VI CRISPR-Cas locus effector protein comprises any polynucleotide sequence having sufficient complementarity with a target nucleic acid sequence to hybridize with the target nucleic acid sequence and direct sequence-specific binding of a RNA-targeting complex to the target nucleic acid sequence, i.e. the target RNA. In some embodiments, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a RNA-targeting guide RNA) to direct sequence-specific binding of a nucleic acid-targeting complex to a target nucleic acid sequence may be assessed by any suitable assay. For example, the components of a RNA-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay. Similarly, cleavage of a target nucleic acid sequence may be evaluated in a test tube by providing the target nucleic acid sequence, components of a nucleic acid-targeting complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a RNA-targeting guide RNA may be selected to target any target nucleic acid sequence. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmatic RNA (scRNA). In some preferred embodiments, the target sequence may be a sequence within a RNA molecule selected from the group consisting of mRNA, pre-mRNA, and rRNA. In some preferred embodiments, the target sequence may be a sequence within a RNA molecule selected from the group consisting of ncRNA, and lncRNA. In some more preferred embodiments, the target sequence may be a sequence within an mRNA molecule or a pre-mRNA molecule.

In some embodiments, a RNA-targeting guide RNA is selected to reduce the degree secondary structure within the RNA-targeting guide RNA. In some embodiments, about or less than about 75%, 50%, 40%, 30%, 25%, 20%, 15%, 10%, 5%, 1%, or fewer of the nucleotides of the RNA-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

In certain embodiments, a guide RNA or crRNA may comprise, consist essentially of, or consist of a direct repeat (DR) sequence and a guide sequence or spacer sequence. In certain embodiments, the guide RNA or crRNA may comprise, consist essentially of, or consist of a direct repeat sequence fused or linked to a guide sequence or spacer sequence. In certain embodiments, the direct repeat sequence may be located upstream (i.e., 5') from the guide sequence or spacer sequence. In other embodiments, the direct repeat sequence may be located downstream (i.e., 3') from the guide sequence or spacer sequence.

In certain embodiments, the crRNA comprises a stem loop, preferably a single stem loop. In certain embodiments, the direct repeat sequence forms a stem loop, preferably a single stem loop.

In certain embodiments, the spacer length of the guide RNA is from 15 to 35 nt. In certain embodiments, the spacer length of the guide RNA is at least 15 nucleotides, preferably at least 18 nt, such at at least 19, 20, 21, 22, or more nt. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer.

Applicants also perform a challenge experiment to verify the RNA targeting and cleaving capability of a C2c2. This experiment closely parallels similar work in *E. coli* for the heterologous expression of StCas9 (Sapranauskas, R. et al. Nucleic Acids Res 39, 9275-9282 (2011)). Applicants introduce a plasmid containing both a PAM and a resistance gene into the heterologous *E. coli*, and then plate on the corresponding antibiotic. If there is RNA cleavage of the plasmid transcribed resistance gene, Applicants observe no viable colonies.

In further detail, the assay is as follows for a DNA target, but may be adapted accordingly for an RNA target. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12 h after transformation, all colonies formed by the test and control strains where harvested and plasmid DNA was isolated. Plasmid DNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM.

For minimization of toxicity and off-target effect, it will be important to control the concentration of RNA-targeting guide RNA delivered. Optimal concentrations of nucleic acid-targeting guide RNA can be determined by testing different concentrations in a cellular or plant model and using deep sequencing the analyze the extent of modification at potential off-target genomic loci. The concentration that gives the highest level of on-target modification while minimizing the level of off-target modification should be chosen for in vivo delivery. The RNA-targeting system is derived advantageously from a Type VI CRISPR system. In some embodiments, one or more elements of a RNA-targeting system is derived from a particular organism comprising an endogenous RNA-targeting system. In particular embodiments, the Type VI RNA-targeting Cas enzyme is C2c2. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In embodiments, the Type VI protein such as C2c2 as referred to herein also encompasses a homologue or an orthologue of a Type VI protein such as C2c2. The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of. Homologous proteins may but need not be structurally related, or are only partially structurally related. An "orthologue" of a protein as used herein is a protein of a different species which performs the same or a similar function as the protein it is an orthologue of. Orthologous proteins may but need not be structurally related, or are only partially structurally related. In particular embodiments, the homologue or orthologue of a Type VI protein such as C2c2 as referred to herein has a sequence homology or identity of at least 80%, more preferably at least 85%, even more preferably at least 90%, such as for instance at least 95% with a Type VI protein such as C2c2. In further embodiments, the homologue or orthologue of a Type VI protein such as C2c2 as referred to herein has a sequence identity of at least 80%, more preferably at least 85%, even more preferably at least 90%, such as for instance at least 95% with the wild type C2c2.

In an embodiment, the Cas protein may be a C2c2 ortholog of an organism of a genus which includes, but is not limited to, *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. Species of organism of such a genus can be as otherwise herein discussed.

Some methods of identifying orthologs of CRISPR-Cas system enzymes may involve identifying tracr sequences in genomes of interest. Identification of tracr sequences may relate to the following steps: Search for the direct repeats or tracr mate sequences in a database to identify a CRISPR region comprising a CRISPR enzyme. Search for homologous sequences in the CRISPR region flanking the CRISPR enzyme in both the sense and antisense directions. Look for transcriptional terminators and secondary structures. Identify any sequence that is not a direct repeat or a tracr mate sequence but has more than 50% identity to the direct repeat or tracr mate sequence as a potential tracr sequence. Take the potential tracr sequence and analyze for transcriptional terminator sequences associated therewith.

It will be appreciated that any of the functionalities described herein may be engineered into CRISPR enzymes from other orthologs, including chimeric enzymes comprising fragments from multiple orthologs. Examples of such orthologs are described elsewhere herein. Thus, chimeric enzymes may comprise fragments of CRISPR enzyme orthologs of an organism which includes, but is not limited to, *Leptotrichia, Listeria, Corynebacter, Sutterella, Legionella, Treponema, Filifactor, Eubacterium, Streptococcus, Lactobacillus, Mycoplasma, Bacteroides, Flaviivola, Flavobacterium, Sphaerochaeta, Azospirillum, Gluconacetobacter, Neisseria, Roseburia, Parvibaculum, Staphylococcus, Nitratifractor, Mycoplasma* and *Campylobacter*. A chimeric enzyme can comprise a first fragment and a second fragment, and the fragments can be of CRISPR enzyme orthologs of organisms of genuses herein mentioned or of species herein mentioned; advantageously the fragments are from CRISPR enzyme orthologs of different species.

In embodiments, the CRISPR effector protein as referred to herein also encompasses a functional variant of CRISPR effector protein or a homologue or an orthologue thereof. A "functional variant" of a protein as used herein refers to a variant of such protein which retains at least partially the activity of that protein. Functional variants may include mutants (which may be insertion, deletion, or replacement mutants), including polymorphs, etc. Also included within functional variants are fusion products of such protein with another, usually unrelated, nucleic acid, protein, polypeptide or peptide. Functional variants may be naturally occurring or may be man-made. Advantageous embodiments can involve engineered or non-naturally occurring Type VI RNA-targeting effector protein.

In an embodiment, nucleic acid molecule(s) encoding the CRISPR effector protein or an ortholog or homolog thereof, may be codon-optimized for expression in an eukaryotic cell. A eukaryote can be as herein discussed. Nucleic acid molecule(s) can be engineered or non-naturally occurring.

In an embodiment, the CRISPR effector protein or an ortholog or homolog thereof, may comprise one or more mutations (and hence nucleic acid molecule(s) coding for same may have mutations). The mutations may be artificially introduced mutations and may include, but are not limited to, one or more mutations in a catalytic domain. Examples of catalytic domains with reference to a Cas9 enzyme may include, but are not limited to, RuvC I, RuvC II, RuvC III and HNH domains.

In an embodiment, the CRISPR effector protein or an ortholog or homolog thereof, may comprise one or more mutations. The mutations may be artificially introduced mutations and may include, but are not limited to, one or more mutations in a catalytic domain. Examples of catalytic domains with reference to a Cas enzyme may include, but are not limited to, HEPN domains.

In an embodiment, the CRISPR effector protein or an ortholog or homolog thereof, may be used as a generic nucleic acid binding protein with fusion to or being operably linked to a functional domain. Exemplary functional domains may include, but are not limited to, translational initiator, translational activator, translational repressor, nucleases, in particular ribonucleases, a spliceosome, beads, a light inducible/controllable domain or a chemically inducible/controllable domain.

In some embodiments, the unmodified RNA-targeting effector protein may have cleavage activity. In some embodiments, the RNA-targeting effector protein may direct cleavage of one or both nucleic acid strands at the location of or near a target sequence, such as within the target sequence and/or within the complement of the target sequence or at sequences associated with the target sequence. In some embodiments, RNA-targeting Cas protein may direct cleavage of one or both RNA strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a RNA-targeting Cas protein that may be mutated with respect to a corresponding wild-type enzyme such that the mutated RNA-targeting Cas protein lacks the ability to cleave RNA strands of a target polynucleotide containing a target sequence. As a further example, two or more catalytic domains of Cas (e.g. HEPN domain) may be mutated to produce a mutated Cas substantially lacking all RNA cleavage activity. In some embodiments, a nucleic acid-targeting effector protein may be considered to substantially lack all RNA cleavage activity when the RNA cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form. An effector protein may be identified with reference to the general class of enzymes that share homology to the biggest nuclease with multiple nuclease domains from the Type VI CRISPR system. Most preferably, the effector protein is a Type VI protein such as C2c2. By derived, Applicants mean that the derived enzyme is largely based, in the sense of having a high degree of sequence homology with, a wild-type enzyme, but that it has been mutated (modified) in some way as known in the art or as described herein.

Again, it will be appreciated that the terms Cas and CRISPR enzyme and CRISPR protein and Cas protein are generally used interchangeably and at all points of reference herein refer by analogy to novel CRISPR effector proteins further described in this application, unless otherwise apparent, such as by specific reference to Cas9. As mentioned above, many of the residue numberings used herein refer to the effector protein from the Type VI CRISPR locus. However, it will be appreciated that this invention includes many more effector proteins from other species of microbes. In certain embodiments, Cas may be constitutively present or inducibly present or conditionally present or administered or delivered. Cas optimization may be used to enhance function or to develop new functions, one can generate chimeric Cas proteins. And Cas may be used as a generic nucleic acid binding protein.

Typically, in the context of an endogenous RNA-targeting system, formation of a RNA-targeting complex (comprising a guide RNA hybridized to a target sequence and complexed with one or more RNA-targeting effector proteins) results in cleavage of RNA strand in or near (e.g., within 1, 2, 3, 4, 5, 6, 7, 8, 9, 10, 20, 50, 100, 200, 500, or more base pairs from) the target sequence. As used herein the term "sequence(s) associated with a target sequence" refers to sequences near the vicinity of the target sequence (e.g. within 1, 2, 3, 4, 5, 6, 7, 8, 9, 10, 20, 50, 100, 200, 500, or more base pairs from the target sequence, wherein the target sequence is comprised within a target sequence).

An example of a codon optimized sequence, is in this instance a sequence optimized for expression in a eukaryote; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., C2c2) is within the ambit of the skilled artisan). Codon optimization for a host species other than human, or for codon optimization for specific tissues is known. In some embodiments, an enzyme coding sequence encoding a RNA-targeting Cas protein is codon optimized for expression in particular cells, such as eukaryotic cells. The eukaryotic cells may be those of or derived from a particular organism, such as a plant. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/ and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. For example, codon optimization in plants can be done using methods known in the art. Plant codon usage is known for example from E Murray et al., Nucleic Acids Res. 1989 Jan. 25; 17(2): 477-498. Further guidance is found also in the article by S. Kumar et al., "Plant codon optimized cry genes of *Bacillus thuringiensis* can be expressed as soluble proteins in *Escherichia coli* BL21 Codon Plus strain as NusA-Cry protein fusions", Journal of Invertebrate Pathology, Volume 88, Issue 1, January 2005, Pages 83-86.

In some embodiments, a vector encodes a RNA-targeting effector protein such as the C2c2, or an ortholog or homolog thereof comprising one or more nuclear localization sequences (NLSs) or nuclear export sequences (NESs), such as about or more than about 1, 2, 3, 4, 5, 6, 7, 8, 9, 10, or more NLSs or NESs. In some embodiments, the RNA-targeting effector protein comprises about or more than about 1, 2, 3, 4, 5, 6, 7, 8, 9, 10, or more NLSs or NESs at or near the amino-terminus, about or more than about 1, 2, 3, 4, 5, 6, 7, 8, 9, 10, or more NLSs or NESs at or near the carboxy-terminus, or a combination of these (e.g., zero or at least one or more NLS or NES at the amino-terminus and zero or at one or more NLS or NES at the carboxy terminus). When more than one NLS or NES is present, each may be selected independently of the others, such that a single NLS or NES may be present in more than one copy and/or in combination with one or more other NLSs or NESs present in one or more copies. In some embodiments, an NLS or NES is considered near the N- or C-terminus when the nearest amino acid of the NLS or NES is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ. I.D. No. 72); the NLS from nucleoplasmin (e.g., the nucleoplasmin bipartite NLS with the sequence KRPAATKKAGQAKKKK) (SEQ. I.D. No. 28); the c-myc NLS having the amino acid sequence PAAKRVKLD (SEQ. I.D. No. 29) or RQRRNELKRSP (SEQ. I.D. No. 30); the hRNPA1 M9 NLS having the sequence NQSSNFGPMKGGNFGGRSSGPYGGGGQYFAKPRNQGGY (SEQ. I.D. No. 31); the sequence RMRIZFKNKGKDTAELRRRRVEVSVELRKAKKDEQILKRRNV (SEQ. I.D. No. 32) of the IBB domain from importin-alpha; the sequences VSRKRPRP (SEQ. I.D. No. 33) and PPKKARED (SEQ. I.D. No. 34) of the myoma T protein; the sequence PQPKKKPL (SEQ. I.D. No. 35) of human p53; the sequence SALIKKKKKMAP (SEQ. I.D. No. 36) of mouse c-abl IV; the sequences DRLRR (SEQ. I.D. No. 37) and PKQKKRK (SEQ. I.D. No. 38) of the influenza virus NS1; the sequence RKLKKKIKKL (SEQ. I.D. No. 39) of the Hepatitis virus delta antigen; the sequence REKKKFLKRR (SEQ. I.D. No. 40) of the mouse Mx1 protein; the sequence KRKGDEVDGVDEVAKKKSKK (SEQ. I.D. No. 41) of the human poly(ADP-ribose) polymerase; and the sequence RKCLQAGMNLEARKTKK (SEQ. I.D. No. 42) of the steroid hormone receptors (human) glucocorticoid. In general, the one or more NLSs or NESs are of sufficient strength to drive accumulation of the RNA-targeting Cas protein in a detectable amount in respectively the nucleus or cytoplasm of a eukaryotic cell, in particular of a plant cell. In general, strength of nuclear/cytoplasmic localization activity may derive from the number of NLSs or NESs in the RNA-targeting effector protein, the particular NLS(s) or NES(s) used, or a combination of these factors. Detection of accumulation in the nucleus/cytoplasm may be performed by any suitable technique. For example, a detectable marker may be fused to the RNA-targeting protein, such that location within a cell may be visualized, such as in combination with a means for detecting the location of the nucleus (e.g., a stain specific for the nucleus such as DAPI) or cytoplasm. Cell nuclei may also be isolated from cells, the contents of which may then be analyzed by any suitable process for detecting protein, such as immunohistochemistry, Western blot, or enzyme activity assay. Accumulation in the nucleus/cytoplasm may also be determined indirectly, such as by an assay for the effect of RNA-targeting complex formation (e.g., assay for RNA cleavage or mutation at the target sequence, or assay for altered gene expression activity affected by RNA-targeting complex formation and/or RNA-targeting Cas protein activity), as compared to a control not exposed to the RNA-targeting Cas protein or RNA-targeting complex, or exposed to a RNA-targeting Cas protein lacking the one or more NLSs or NESs. In preferred embodiments of the herein described C2c2 effector protein complexes and systems, the codon optimized C2c2 effector proteins comprise an NLS or NES attached to the C-terminal of the protein.

In some embodiments, one or more vectors driving expression of one or more elements of a RNA-targeting system are introduced into a host cell such that expression of the elements of the RNA-targeting system direct formation of a RNA-targeting complex at one or more target sites. For example, a RNA-targeting effector enzyme and a RNA-targeting guide RNA could each be operably linked to separate regulatory elements on separate vectors. RNA(s) of the RNA-targeting system can be delivered to a transgenic RNA-targeting effector protein plant, e.g., a plant that constitutively or inducibly or conditionally expresses RNA-targeting effector protein; or a plant that is otherwise expressing RNA-targeting effector protein or has cells containing RNA-targeting effector protein, such as by way of prior administration thereto of a vector or vectors that code for and express in vivo RNA-targeting effector protein. Alternatively, two or more of the elements expressed from the same or different regulatory elements, may be combined in a single vector, with one or more additional vectors providing any components of the RNA-targeting system not included in the first vector. RNA targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a RNA-targeting effector protein and the RNA-targeting guide RNA, embedded within one or more intron sequences (e.g., each in a different intron, two or more in at least one intron, or all in a single intron). In some embodiments, the RNA-targeting effector protein and the RNA-targeting guide RNA may be operably linked to and expressed from the same promoter. Delivery vehicles, vectors, particles, nanoparticles, formulations and components thereof for expression of one or more elements of a RNA-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. In some embodiments, a vector comprises two or more insertion sites, so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target RNA-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a RNA-targeting effector protein. RNA-targeting effector protein or RNA-targeting guide RNA or RNA(s) can be delivered separately; and advantageously at least one of these is delivered via a particle or nanoparticle complex. RNA-targeting effector protein mRNA can be delivered prior to the RNA-targeting guide RNA to give time for RNA-targeting effector protein to be expressed. RNA-targeting effector protein mRNA might be administered 1-12 hours (preferably around 2-6 hours) prior to the administration of RNA-targeting guide RNA. Alternatively, RNA-targeting effector protein mRNA and RNA-targeting guide RNA can be administered together. Advantageously, a second booster dose of guide RNA can be administered 1-12 hours (preferably around 2-6 hours) after the initial administration of RNA-targeting effector protein mRNA+guide RNA. Additional administrations of RNA-targeting effector protein mRNA and/or guide RNA might be useful to achieve the most efficient levels of genome and/or transcriptome modification.

In one aspect, the invention provides methods for using one or more elements of a RNA-targeting system. The RNA-targeting complex of the invention provides an effective means for modifying a target RNA. The RNA-targeting complex of the invention has a wide variety of utility including modifying (e.g., deleting, inserting, translocating, inactivating, activating) a target RNA in a multiplicity of cell types. As such the RNA-targeting complex of the invention has a broad spectrum of applications in, e.g., gene therapy, drug screening, disease diagnosis, and prognosis. An exemplary RNA-targeting complex comprises a RNA-targeting effector protein complexed with a guide RNA hybridized to a target sequence within the target RNA.

In one embodiment, this invention provides a method of cleaving a target RNA. The method may comprise modifying a target RNA using a RNA-targeting complex that binds to the target RNA and effects cleavage of said target RNA. In an embodiment, the RNA-targeting complex of the invention, when introduced into a cell, may create a break (e.g., a single or a double strand break) in the RNA sequence. For example, the method can be used to cleave a disease RNA in a cell. For example, an exogenous RNA template comprising a sequence to be integrated flanked by an upstream sequence and a downstream sequence may be introduced into a cell. The upstream and downstream sequences share sequence similarity with either side of the site of integration in the RNA. Where desired, a donor RNA can be mRNA. The exogenous RNA template comprises a sequence to be integrated (e.g., a mutated RNA). The sequence for integration may be a sequence endogenous or exogenous to the cell. Examples of a sequence to be integrated include RNA encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous RNA template are selected to promote recombination between the RNA sequence of interest and the donor RNA. The upstream sequence is a RNA sequence that shares sequence similarity with the RNA sequence upstream of the targeted site for integration. Similarly, the downstream sequence is a RNA sequence that shares sequence similarity with the RNA sequence downstream of the targeted site of integration. The upstream and downstream sequences in the exogenous RNA template can have 75%, 80%, 85%, 90%, 95%, or 100% sequence identity with the targeted RNA sequence. Preferably, the upstream and downstream sequences in the exogenous RNA template have about 95%, 96%, 97%, 98%, 99%, or 100% sequence identity with the targeted RNA sequence. In some methods, the upstream and downstream sequences in the exogenous RNA template have about 99% or 100% sequence identity with the targeted RNA sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous RNA template may further comprise a marker. Such a marker may make it easy to screen for targeted integrations. Examples of suitable markers include restriction sites, fluorescent proteins, or selectable markers. The exogenous RNA template of the invention can be constructed using recombinant techniques (see, for example, Sambrook et al., 2001 and Ausubel et al., 1996). In a method for modifying a target RNA by integrating an exogenous RNA template, a break (e.g., single stranded break in single stranded RNA) is introduced into the RNA sequence by the RNA-targeting complex, the break is repaired via homologous recombination with an exogenous RNA template such that the template is integrated into the RNA target. The presence of a double-stranded break facilitates integration of the template. In other embodiments, this invention provides a method of modifying expression of a RNA in a eukaryotic cell. The method comprises increasing or decreasing expression of a target polynucleotide by using a RNA-targeting complex that binds to the RNA (e.g., mRNA or pre-mRNA). In some methods, a target RNA can be inactivated to effect the modification of the expression in a cell. For example, upon the binding of a RNA-targeting complex to a target sequence in a cell, the target RNA is inactivated such that the sequence is not translated, the coded protein is not produced, or the sequence does not function as the wild-type sequence does. For example, a protein or microRNA coding sequence may be inactivated such that the protein or microRNA or pre-microRNA transcript is not produced. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA). Examples of target RNA include a sequence associated with a signaling biochemical pathway, e.g., a signaling biochemical pathway-associated RNA. Examples of target RNA include a disease associated RNA. A "disease-associated" RNA refers to any RNA which is yielding translation products at an abnormal level or in an abnormal form in cells derived from a disease-affected tissue compared with tissues or cells of a non disease control. It may be a RNA transcribed from a gene that becomes expressed at an abnormally high level; it may be a RNA transcribed from a gene that becomes expressed at an abnormally low level, where the altered expression correlates with the occurrence and/or progression of the disease. A disease-associated RNA also refers to a RNA transcribed from a gene possessing mutation(s) or genetic variation that is directly responsible or is in linkage disequilibrium with a gene(s) that is responsible for the etiology of a disease. The translated products may be known or unknown, and may be at a normal or abnormal level. The target RNA of a RNA-targeting complex can be any RNA endogenous or exogenous to the eukaryotic cell. For example, the target RNA can be a RNA residing in the nucleus of the eukaryotic cell. The target RNA can be a sequence (e.g., mRNA or pre-mRNA) coding a gene product (e.g., a protein) or a non-coding sequence (e.g., ncRNA, lncRNA, tRNA, or rRNA).

In some embodiments, the method may comprise allowing a RNA-targeting complex to bind to the target RNA to effect cleavage of said target RNA or RNA thereby modifying the target RNA, wherein the RNA-targeting complex comprises a RNA-targeting effector protein complexed with a guide RNA hybridized to a target sequence within said target RNA. In one aspect, the invention provides a method of modifying expression of RNA in a eukaryotic cell. In some embodiments, the method comprises allowing a RNA-targeting complex to bind to the RNA such that said binding results in increased or decreased expression of said RNA; wherein the RNA-targeting complex comprises a RNA-targeting effector protein complexed with a guide RNA. Similar considerations and conditions apply as above for methods of modifying a target RNA. In fact, these sampling, culturing and re-introduction options apply across the aspects of the present invention. In one aspect, the invention provides for methods of modifying a target RNA in a eukaryotic cell, which may be in vivo, ex vivo or in vitro. In some embodiments, the method comprises sampling a cell or population of cells from a plant, and modifying the cell or cells. Culturing may occur at any stage ex vivo. The cell or cells may even be re-introduced into the plant. For re-introduced cells, it is particularly preferred that the cells are stem cells.

Indeed, in any aspect of the invention, the RNA-targeting complex may comprise a RNA-targeting effector protein complexed with a guide RNA hybridized to a target sequence.

The invention relates to the engineering and optimization of systems, methods and compositions used for the control of gene expression involving RNA sequence targeting, that relate to the RNA-targeting system and components thereof. An advantage of the present methods is that the CRISPR system minimizes or avoids off-target binding and its resulting side effects. This is achieved using systems arranged to have a high degree of sequence specificity for the target RNA.

In certain embodiments, the effector protein may be a *Listeria* sp. C2c2p, preferably *Listeria seeligeria* C2c2p, more preferably *Listeria seeligeria* serovar 1/2b str. SLCC3954 C2c2p and the crRNA sequence may be 44 to 47 nucleotides in length, with a 5' 29-nt direct repeat (DR) and a 15-nt to 18-nt spacer.

In certain embodiments, the effector protein may be a *Leptotrichia* sp. C2c2p, preferably *Leptotrichia shahii* C2c2p, more preferably *Leptotrichia shahii* DSM 19757 C2c2p and the crRNA sequence may be 42 to 58 nucleotides in length, with a 5' direct repeat of at least 24 nt, such as a 5' 24-28-nt direct repeat (DR) and a spacer of at least 14 nt, such as a 14-nt to 28-nt spacer, or a spacer of at least 18 nt, such as 19, 20, 21, 22, or more nt, such as 18-28, 19-28, 20-28, 21-28, or 22-28 nt.

More preferably, the effector protein may be a *Listeria* sp., preferably *Listeria newyorkensis* FSL M6-0635.

In certain embodiments, the effector protein is not a *Leptotrichia* sp., preferably not *Leptotrichia wadei* F0279.

In certain embodiments, the crRNA sequence may be 36 to 63 nucleotides in length, preferably 37-nt to 62-nt in length, or 38-nt to 61-nt in length, or 39-nt to 60-nt in length, more preferably 40-nt to 59-nt in length, or 41-nt to 58-nt in length, most preferably 42-nt to 57-nt in length. For example, the crRNA may comprise, consist essentially of or consist of a direct repeat (DR), preferably a 5' DR, 26-nt to 31-nt in length, preferably 27-nt to 30-nt in length, even more preferably 28-nt or 29-nt in length or at least 28 or 29 nt in length, and a spacer 10-nt to 32-nt in length, preferably 11-nt to 31-nt in length, more preferably 12-nt to 30-nt in length, even more preferably 13-nt to 29-nt in length, and most preferably 14-nt to 28-nt in length, such as 18-28 nt, 19-28 nt, 20-28 nt, 21-28 nt, or 22-28 nt.

The use of two different aptamers (each associated with a distinct RNA-targeting guide RNAs) allows an activator-adaptor protein fusion and a repressor-adaptor protein fusion to be used, with different RNA-targeting guide RNAs, to activate expression of one RNA, whilst repressing another. They, along with their different guide RNAs can be administered together, or substantially together, in a multiplexed approach. A large number of such modified RNA-targeting guide RNAs can be used all at the same time, for example 10 or 20 or 30 and so forth, whilst only one (or at least a minimal number) of effector protein molecules need to be delivered, as a comparatively small number of effector protein molecules can be used with a large number modified guides. The adaptor protein may be associated (preferably linked or fused to) one or more activators or one or more repressors. For example, the adaptor protein may be associated with a first activator and a second activator. The first and second activators may be the same, but they are preferably different activators. Three or more or even four or more activators (or repressors) may be used, but package size may limit the number being higher than 5 different functional domains. Linkers are preferably used, over a direct fusion to the adaptor protein, where two or more functional domains are associated with the adaptor protein. Suitable linkers might include the GlySer linker.

It is also envisaged that the RNA-targeting effector protein-guide RNA complex as a whole may be associated with two or more functional domains. For example, there may be two or more functional domains associated with the RNA-targeting effector protein, or there may be two or more functional domains associated with the guide RNA (via one or more adaptor proteins), or there may be one or more functional domains associated with the RNA-targeting effector protein and one or more functional domains associated with the guide RNA (via one or more adaptor proteins).

The fusion between the adaptor protein and the activator or repressor may include a linker. For example, GlySer linkers GGGS can be used. They can be used in repeats of 3 ((GGGGS)$_3$) or 6, 9 or even 12 or more, to provide suitable lengths, as required. Linkers can be used between the guide RNAs and the functional domain (activator or repressor), or between the RNA-targeting effector protein and the functional domain (activator or repressor). The linkers are used to engineer appropriate amounts of "mechanical flexibility".

The invention comprehends a RNA-targeting complex comprising a RNA-targeting effector protein and a guide RNA, wherein the RNA-targeting effector protein comprises at least one mutation, such that the RNA-targeting Cas protein has no more than 5% of the activity of the RNA-targeting Cas protein not having the at least one mutation and, optionally, at least one or more nuclear localization sequences; the guide RNA comprises a guide sequence capable of hybridizing to a target sequence in a RNA of interest in a cell; and wherein: the RNA-targeting effector protein is associated with two or more functional domains; or at least one loop of the guide RNA is modified by the insertion of distinct RNA sequence(s) that bind to one or more adaptor proteins, and wherein the adaptor protein is associated with two or more functional domains; or the RNA-targeting effector protein is associated with one or more functional domains and at least one loop of the guide RNA is modified by the insertion of distinct RNA sequence(s) that bind to one or more adaptor proteins, and wherein the adaptor protein is associated with one or more functional domains.

Unlike CRISPR-Cas-mediated gene knockout, which permanently eliminates expression by mutating the gene at the DNA level, CRISPR-Cas knockdown allows for temporary reduction of gene expression through the use of artificial transcription or translation factors. Mutating key residues in both RNA cleavage domains of the CRISPR effector protein, e.g. C2c2, results in the generation of a catalytically inactive CRISPR effector protein, e.g. C2c2. A catalytically inactive CRISPR effector protein, e.g. C2c2 complexes with a guide RNA and localizes to the RNA sequence specified by that guide RNA's targeting domain, however, it does not cleave the target RNA. Fusion of the inactive CRISPR effector protein, e.g. C2c2 to an effector domain, e.g., a transcription or translation repression domain, enables recruitment of the effector to any RNA site specified by the guide RNA. In certain embodiments, a CRISPR effector protein, e.g. C2c2 may be fused to a transcriptional repression domain and recruited to the promoter region of a gene. Especially for gene repression, it is contemplated herein that blocking the binding site of an endogenous transcription factor would aid in downregulating gene expression. In further embodiments, CRISPR effector protein, e.g. C2c2 may be fused to a translation repression domain.

In an embodiment, a guide RNA molecule can be targeted to known transcription response elements (e.g., promoters, enhancers, etc.), known upstream activating sequences, and/or sequences of unknown or known function that are suspected of being able to control (protein) expression of the target RNA.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein is not produced. In some methods, a target polynucleotide can be inactivated to effect the modification of the expression in a cell. For example, upon the binding of a CRISPR complex to an RNA target sequence in a cell, the target polynucleotide is inactivated such that the sequence is not translated, affecting the expression level of the protein in the cell.

In particular embodiments, the CRISPR enzyme comprises one or more mutations selected from the group consisting of R597A, H602A, R1278A and H1283A and/or the one or more mutations are in the HEPN domain of the CRISPR enzyme or is a mutation as otherwise discussed herein. In some embodiments, the CRISPR enzyme has one or more mutations in a catalytic domain, wherein when transcribed, the direct repeat sequence forms a single stem loop and the guide sequence directs sequence-specific binding of a CRISPR complex to the target sequence, and wherein the enzyme further comprises a functional domain. In some embodiments, the functional domain is a transcription repression domain, preferably KRAB. In some embodiments, the transcription repression domain is SID, or concatemers of SID (e.g., SID4X). In some embodiments, the functional domain is an epigenetic modifying domain, such that an epigenetic modifying enzyme is provided. In some embodiments, the functional domain is an activation domain, which may be the P65 activation domain.

Delivery of the C2c2 Effector Protein Complex or Components Thereof

Through this disclosure and the knowledge in the art, CRISPR-Cas systems, or components thereof or nucleic acid molecules thereof or nucleic acid molecules encoding or providing components thereof may be delivered by a delivery system herein described both generally and in detail.

Vector delivery, e.g., plasmid, viral delivery: The CRISPR enzyme, for instance a Type VI protein such as C2c2, and/or any of the present RNAs, for instance, a guide RNA, can be delivered using any suitable vector, e.g., plasmid or viral vectors, such as geminivirus or other viral vector types, or combinations thereof. Effector proteins and one or more guide RNAs can be packaged into one or more vectors, e.g., plasmid or viral vectors. In some embodiments, the vector, e.g., plasmid or viral vector is delivered to the tissue of interest by, for example, particle bombardment, PEG treatment, microinjection, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the plant to be treated, the degree of transformation/modification sought, the administration route, the administration mode, the type of transformation/modification sought, etc.

A composition for delivering a CRISPR system may further contain, for example, a carrier (water, saline, ethanol, glycerol, lactose, sucrose, calcium phosphate, gelatin, dextran, agar, pectin, peanut oil, sesame oil, etc.), a diluent, a carrier (e.g., phosphate-buffered saline), an excipient, and/or other compounds known in the art. The composition may further contain one or more acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional ingredients, such as preservatives, humectants, suspending agents, surfactants, antioxidants, anticaking agents, fillers, chelating agents, coating agents, chemical stabilizers, etc. may also be present.

In an embodiment herein the delivery is via a virus, which may be at a single booster dose containing at least $1\times10^5$ particles (also referred to as particle units, pu) of viral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^9$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the viral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of viral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of viral vector. In an embodiment herein, the virus is delivered via multiple doses.

In an embodiment herein the delivery is via a plasmid. In such plasmid compositions, the dosage should be a sufficient amount of plasmid to elicit a response. Plasmids of the invention will generally comprise (i) a promoter; (ii) a sequence encoding an RNA-targeting CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Indeed, RNA delivery is a useful method of in vivo delivery. It is possible to deliver RNA-targeting Cas protein and gRNA (and, for instance, HR repair template) into cells using liposomes or particles. Thus, delivery of the RNA-targeting Cas protein/CRISPR enzyme, such as a C2c2 and/or delivery of the guide RNAs of the invention may be in RNA form and via microvesicles, liposomes or particles. For example, Cas mRNA and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the RNA-targeting system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purified and characterized from transfected cell supernatant, then RNA is loaded into the exosomes. Delivery or administration according to the invention can be performed with exosomes.

Packaging and Promoters Generally

Ways to package RNA-targeting effector coding nucleic acid molecules, e.g., DNA, into vectors, e.g., viral vectors, to mediate genome modification in vivo include:

Single virus vector:
Vector containing two or more expression cassettes:
Promoter-RNA-targeting effector protein coding nucleic acid molecule-terminator
Promoter—guide RNA1-terminator
Promoter—guide RNA (N)-terminator (up to size limit of vector)

Double virus vector:
Vector 1 containing one expression cassette for driving the expression of RNA-targeting effector protein
Promoter-RNA-targeting effector protein coding nucleic acid molecule-terminator
Vector 2 containing one more expression cassettes for driving the expression of one or more guideRNAs
Promoter—guide RNA1-terminator
Promoter—guide RNA1 (N)-terminator (up to size limit of vector)

In addition to the single and double virus vector approaches described above, an additional vector may be used to deliver a homology-direct repair template.

The promoter used to drive RNA-targeting effector protein coding nucleic acid molecule expression can include:

For ubiquitous and constitutive expression in plants, one can, for example, use promoters: cauliflower mosaic virus 35S promoter (in particular in dicots),
rice actin promoter (in particular in monocots),
promoter from maize ubiquitin gene (Ubi).

For temporally and spatially restricted and/or inducible expression one may, for example, use PSPAL1 promoter (Kawamata et al., Plant Cell Physiol. 38: 792-803, 1997), the alcohol dehydrogenase (alcA) which is active only upon binding of the AlcR transcriptional activator in the presence of ethanol (Werner et al., Proc Natl Acad Sci USA. 2011 Aug. 23; 108(34): 14061-14066), seed-specific promoters (in soybean) include the β-conglycincin (7S) and glycinin (11S) promoters (Eckert et al., 2006; Nielsen et al., 1989).

Further information on plant promoters can be found, for example, in Examples of particular promoters for use in the RNA targeting CRISPR system—are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

The promoter used to drive guide RNA can include:
Pol III promoters such as U6 or H1
Use of Pol II promoter and intronic cassettes to express guide RNA Preferably, the rice U6 promoter and the *arabidopsis* U6 promoter are used to drive gRNA in monocots and dicots, respectively.

Rna Delivery

RNA delivery: The RNA-targeting Cas protein, for instance a Type VI protein such as C2c2, and/or guide RNA, can also be delivered in the form of RNA. RNA-targeting Cas protein (such as a Type VI protein such as C2c2) mRNA can be generated using in vitro transcription. For example, RNA-targeting effector protein (such as a Type VI protein such as C2c2) mRNA can be synthesized using a PCR cassette containing the following elements: T7_promoter-kozak sequence (GCCACC)-effector protein-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the RNA-targeting effector protein-coding sequence and/or the guide RNA can be modified to include one or more modified nucleoside e.g., using pseudo-U or 5-Methyl-C.

Work on RNA delivery has focused on RNAi or antisense, but these systems can be adapted for delivery of RNA for implementing the present invention. References below to RNAi etc. should be read accordingly.

Particle Delivery Systems and/or Formulations

Several types of particle delivery systems and/or formulations are known to be useful in a diverse spectrum of applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarisation interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR enzyme or mRNA or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particle delivery systems within the scope of the present invention may be provided in any form, including, but not limited to, solid, semi-solid, emulsion, or colloidal particles. As such any of the delivery systems described herein, including, but not limited to, e.g., lipid-based systems, liposomes, micelles, microvesicles, exosomes, or gene gun may be provided as particle delivery systems within the scope of the present invention.

Particles

CRISPR enzyme mRNA and guide RNA may be delivered simultaneously using particles or lipid envelopes; for instance, CRISPR enzyme and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes).

RNA-targeting effector proteins (such as a Type VI protein such as C2c2) mRNA and guide RNA may be delivered simultaneously using particles or lipid envelopes.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured particles with a poly(β-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

Cell Penetrating Peptides (CPPs)

In yet another embodiment, cell penetrating peptides (CPPs) are contemplated for the delivery of the CRISPR Cas system. CPPs are short peptides that facilitate cellular uptake of various molecular cargo (from nanosize particles to small chemical molecules and large fragments of DNA). The term "cargo" as used herein includes, but is not limited to, the group consisting of therapeutic agents, diagnostic probes, peptides, nucleic acids, antisense oligonucleotides, plasmids, proteins, particles including nanoparticles, liposomes, chromophores, small molecules and radioactive materials. In aspects of the invention, the cargo may also comprise any component of the CRISPR Cas system or the entire functional CRISPR Cas system. Aspects of the present invention further provide methods for delivering a desired cargo into a plant comprising: (a) preparing a complex comprising the cell penetrating peptide of the present invention and a desired cargo, and (b) administering the complex to a plant or plant part. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include, but are not limited to, Penetratin, Tat (48-60), Transportan, and (R-AhX-R4) (Ahx=aminohexanoyl).

U.S. Pat. No. 8,372,951 provides a CPP derived from eosinophil cationic protein (ECP) which exhibits highly cell-penetrating efficiency and low toxicity. Further aspects of CPPs and their delivery are described in U.S. Pat. Nos. 8,575,305; 8,614,194 and 8,044,019. CPPs can be used to deliver the CRISPR-Cas system or components thereof. That CPPs can be employed to deliver the CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2. [Epub ahead of print], incorporated by reference in its entirety, wherein it is demonstrated that treatment with CPP-conjugated recombinant Cas9 protein and CPP-complexed guide RNAs lead to endogenous gene disruptions in human cell lines. In the paper, the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Transgenic Plants

A transgenic plant is a plant with an insertion of DNA from another organism. Methods for making transgenic plants are well known in the art. Exemplary methods include those described by e.g. Peter Nick at al., AgBiotechNet, 2003, Vol. 5 January ABN 105; Stanton B. Gelvin, Microbiol Mol Biol Rev. 2003 March; 67(1): 16-37; Behrooz Darbani et al., 2008. DNA-Delivery Methods to Produce Transgenic Plants. Biotechnology, 7: 385-402.

Crispr Effector Protein mRNA and Guide RNA

CRISPR effector protein mRNA and guide RNA might also be delivered separately. CRISPR effector protein mRNA can be delivered prior to the guide RNA to give time for CRISPR effector protein to be expressed. CRISPR effector protein mRNA might be administered 1-12 hours (preferably around 2-6 hours) prior to the administration of guide RNA.

Alternatively, CRISPR effector protein mRNA and guide RNA can be administered together. Advantageously, a second booster dose of guide RNA can be administered 1-12 hours (preferably around 2-6 hours) after the initial administration of CRISPR effector protein mRNA+guide RNA.

The CRISPR effector protein of the present invention, i.e. a C2c2 effector protein is sometimes referred to herein as a CRISPR Enzyme. It will be appreciated that the effector protein is based on or derived from an enzyme, so the term 'effector protein' certainly includes 'enzyme' in some embodiments. However, it will also be appreciated that the effector protein may, as required in some embodiments, have RNA binding, but not necessarily cutting or nicking, activity, including a dead-Cas effector protein function. n Additional administrations of CRISPR effector protein mRNA and/or guide RNA might be useful to achieve the most efficient levels of target modification. In some embodiments, phenotypic alteration is preferably the result of target modification when a genetic disease is targeted, especially in methods of therapy and preferably where a repair template is provided to correct or alter the phenotype.

In some embodiments, diseases that may be targeted include those concerned with disease-causing splice defects.

In some embodiments delivery methods include: Cationic Lipid Mediated "direct" delivery of Enzyme-Guide complex (RiboNucleoProtein) and electroporation of plasmid DNA.

Inventive methods can further comprise delivery of templates, such as repair templates, which may be dsODN or ssODN, see below. Preferably, the repair template is an RNA. Delivery of templates may be via the cotemporaneous or separate from delivery of any or all the CRISPR effector protein or guide and via the same delivery mechanism or different. In some embodiments, it is preferred that the template is delivered together with the guide, and, preferably, also the CRISPR effector protein. An example may be a viral vector.

Inventive methods can further comprise: (a) delivering to the cell a double-stranded oligonucleotide repair template comprising overhangs complimentary to the overhangs created by said double strand break, wherein said repair template is integrated into the sequence; or (b) delivering to the cell a single-stranded oligodeoxynucleotide (ssODN), wherein said ssODN acts as a template for homology directed repair of said double strand break. Inventive methods can be for the prevention or treatment of disease in an individual, optionally wherein said disease is caused by a defect in said sequence. Inventive methods can be conducted in vivo in the individual or ex vivo on a cell taken from the individual, optionally wherein said cell is returned to the individual.

For minimization of toxicity and off-target effect, it will be important to control the concentration of CRISPR effector protein mRNA and guide RNA delivered. Optimal concentrations of CRISPR effector protein mRNA and guide RNA can be determined by testing different concentrations in a cellular or plant model and using deep sequencing to analyze the extent of modification at potential off-target genomic loci. For example, for the guide sequence targeting 5'-GAGTCCGAGCAGAAGAAGAA-3' (SEQ ID NO: 45) in the EMX1 gene of the human genome, deep sequencing can be used to assess the level of modification at the following two off-target loci, 1: 5'-GAGTCCTAGCAG-GAGAAGAA-3' (SEQ ID NO: 46) and 2: 5'-GAGTCTAAGCAGAAGAAGAA-3' (SEQ ID NO: 47). The concentration that gives the highest level of on-target modification while minimizing the level of off-target modification should be chosen for in vivo delivery.

Inducible Systems

In some embodiments, a CRISPR effector protein may form a component of an inducible system. The inducible nature of the system would allow for spatiotemporal control of gene editing or gene expression using a form of energy. The form of energy may include, but is not limited to, electromagnetic radiation, sound energy, chemical energy and thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR effector protein may be a part of a Light Inducible Transcriptional Effector (LITE) to direct changes in transcriptional activity in a sequence-specific manner. The components of a light may include a CRISPR effector protein, a light-responsive cytochrome heterodimer (e.g. from *Arabidopsis thaliana*), and a transcriptional activation/repression domain. Further examples of inducible DNA binding proteins and methods for their use are provided in U.S. 61/736, 465 and U.S. 61/721,283, and WO 2014018423 A2, each of which is hereby incorporated by reference in its entirety.

Exemplary Methods of Using of CRISPR Cas System

The invention provides a non-naturally occurring or engineered composition, or one or more polynucleotides encoding components of said composition, or vector or delivery systems comprising one or more polynucleotides encoding components of said composition for use in modifying a target cell in vivo, ex vivo or in vitro and, may be conducted in a manner that alters the cell such that once modified the progeny or cell line of the CRISPR modified cell retains the altered phenotype. The modified cells and progeny may be part of a multi-cellular organism such as a plant with ex vivo or in vivo application of CRISPR system to desired cell types. The CRISPR system of the invention may be used in a therapeutic method of treatment. This encompasses also prophylactic treatment. In particular, delivering the CRISPR system of the invention to a plant cell either after infection with a plant pathogen as a therapy or before infection with the plant pathogen in order to increase resistance of the plant cell to said plant pathogen as a prophylaxis is envisaged.

Modifying a Target with CRISPR Cas System or Complex (e.g., C2c2-RNA Complex)

In one aspect, the invention provides for methods of modifying a target polynucleotide in a eukaryotic cell, which may be in vivo, ex vivo or in vitro. In some embodiments, the method comprises sampling a cell or population of cells from a eukaryotic, such as plant, and modifying the cell or cells. Culturing may occur at any stage ex vivo. The cell or cells may even be re-introduced into the plant. For re-introduced cells, it is particularly preferred that the cells are stem cells.

In some embodiments, the method comprises allowing a CRISPR complex to bind to the target polynucleotide to effect cleavage of said target polynucleotide thereby modifying the target polynucleotide, wherein the CRISPR complex comprises a CRISPR effector protein complexed with a guide sequence hybridized or hybridizable to a target sequence within said target polynucleotide.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR effector protein complexed with a guide sequence hybridized or hybridizable to a target sequence within said polynucleotide. Similar considerations and conditions apply as above for methods of modifying a target polynucleotide. In fact, these sampling, culturing and re-introduction options apply across the aspects of the present invention.

Indeed, in any aspect of the invention, the CRISPR complex may comprise a CRISPR effector protein complexed with a guide sequence hybridized or hybridizable to a target sequence. Similar considerations and conditions apply as above for methods of modifying a target polynucleotide.

Thus, any of the non-naturally-occurring CRISPR effector proteins described herein comprise at least one modification and whereby the effector protein has certain improved capabilities. In particular, any of the effector proteins are capable of forming a CRISPR complex with a guide RNA. When such a complex forms, the guide RNA is capable of binding to a target polynucleotide sequence and the effector protein is capable of modifying a target locus. In addition, the effector protein in the CRISPR complex may have reduced capability of modifying one or more off-target loci as compared to an unmodified enzyme/effector protein.

In addition, the modified CRISPR enzymes described herein encompass enzymes whereby in the CRISPR complex the effector protein has increased capability of modifying the one or more target RNAs as compared to an unmodified enzyme/effector protein. Such function may be provided separate to or provided in combination with the above-described function of reduced capability of modifying one or more off-target loci. Any such effector proteins may be provided with any of the further modifications to the CRISPR effector protein as described herein, such as in combination with any activity provided by one or more associated heterologous functional domains, any further mutations to reduce nuclease activity and the like.

In advantageous embodiments of the invention, the modified CRISPR effector protein is provided with reduced capability of modifying one or more off-target loci as compared to an unmodified enzyme/effector protein and increased capability of modifying the one or more target loci as compared to an unmodified enzyme/effector protein. In combination with further modifications to the effector protein, significantly enhanced specificity may be achieved. For example, combination of such advantageous embodiments with one or more additional mutations is provided wherein the one or more additional mutations are in one or more catalytically active domains. In such effector proteins, enhanced specificity may be achieved due to an improved specificity in terms of effector protein activity.

Additional functionalities which may be engineered into modified CRISPR effector proteins as described herein include the following. 1. modified CRISPR effector proteins that disrupt RNA:protein interactions without affecting protein tertiary or secondary structure. This includes residues that contact any part of the RNA:RNA duplex. 2. modified CRISPR effector proteins that weaken intra-protein interactions holding C2c2 in conformation essential for nuclease cutting in response to RNA binding (on or off target). For example: a modification that mildly inhibits, but still allows, the nuclease conformation of the HEPN domain (positioned at the scissile phosphate). 3. modified CRISPR effector proteins that strengthen intra-protein interactions holding C2c2 in a conformation inhibiting nuclease activity in response to RNA binding (on or off targets). For example: a modification that stabilizes the HEPN domain in a conformation away from the scissile phosphate. Any such additional functional enhancement may be provided in combination with any other modification to the CRISPR effector protein as described in detail elsewhere herein.

Any of the herein described improved functionalities may be made to any CRISPR effector protein, such as a C2c2 effector protein. However, it will be appreciated that any of the functionalities described herein may be engineered into C2c2 effector proteins from other orthologs, including chimeric effector proteins comprising fragments from multiple orthologs.

The invention uses nucleic acids to bind target RNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: transcripts of coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component. As used herein the term "wild type" is a term of the art understood by skilled persons and means the typical form of an organism, strain, gene or characteristic as it occurs in nature as distinguished from mutant or variant forms. A "wild type" can be a base line. As used herein the term "variant" should be taken to mean the exhibition of qualities that have a pattern that deviates from what occurs in nature. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. "Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions. As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridizing to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of specific target sequence hybridizes to a perfectly complementary probe in solution at a defined ionic strength and pH. Generally, in order to require at least about 85% nucleotide complementarity of hybridized sequences, highly stringent washing conditions are selected to be about 5 to 15° C. lower than the $T_m$. In order to require at least about 70% nucleotide complementarity of hybridized sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C. "Hybridization" refers to a reaction in which one or more polynucleotides react to form a complex that is stabilized via hydrogen bonding between the bases of the nucleotide residues. The hydrogen bonding may occur by Watson-Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence. As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and, hence, is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions. As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell. The terms "polypeptide", "peptide" and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics. As used herein, the term "domain" or "protein domain" refers to a part of a protein sequence that may exist and function independently of the rest of the protein chain. As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences.

In aspects of the invention. the term "guide RNA", refers to any polynucleotide sequence having sufficient complementarity with a target nucleic acid sequence to hybridize with the target nucleic acid sequence and to direct sequence-specific binding of a RNA-targeting complex to the target nucleic acid sequence, i.e. the target RNA. The guide mRNA comprises one or more of a putative or identified direct repeat sequence and a putative or identified crRNA sequence or guide sequence. In particular embodiments, the "guide RNA" comprises a putative or identified crRNA sequence or guide sequence. In further embodiments, the guide RNA does not comprise a putative or identified tracr sequence.

As used herein the term "wild type" is a term of the art understood by skilled persons and means the typical form of an organism, strain, gene or characteristic as it occurs in nature as distinguished from mutant or variant forms. A "wild type" can be a base line.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. In all aspects and embodiments, whether they include these terms or not, it will be understood that, preferably, they may be optional and thus preferably included or not preferably not included. Furthermore, the terms "non-naturally occurring" and "engineered" may be used interchangeably and so can therefore be used alone or in combination and one or other may replace mention of both together. In particular, "engineered" is preferred in place of "non-naturally occurring" or "non-naturally occurring and/or engineered."

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However, it is preferred to use the GCG Bestfit program. Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues. Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity. However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension. Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p387). Examples of other software than may perform sequence comparisons include, but are not limited to, the BLAST package (see Ausubel et al., 1999 Short Protocols in Molecular Biology, 4$^{th}$ Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174 (2): 247-50; FEMS Microbiol Lett. 1999 177(1): 187-8 and the website of the National Center for Biotechnology information at the website of the National Institutes for Health). Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62. Alternatively, percentage homologies may be calculated using the multiple alignment feature in DNASIS™ (Hitachi Software), based on an algorithm, analogous to CLUSTAL (Higgins D G & Sharp P M (1988), *Gene* 73(1), 237-244). Once the software has produced an optimal alignment, it is possible to calculate % homology, preferably % sequence identity. The software typically does this as part of the sequence comparison and generates a numerical result. The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" *Comput. Appl. Biosci.* 9: 745-756) (Taylor W. R. (1986) "The classification of amino acid conservation" *J. Theor. Biol.* 119; 205-218). Conservative substitutions may be made, for example according to the table below which describes a generally accepted Venn diagram grouping of amino acids.

or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriylalanine, thienylalanine, naphthylalanine and phenylglycine. Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., *PNAS* (1992) 89(20), 9367-9371 and Horwell D C, *Trends Biotechnol.* (1995) 13(4), 132-134.

Homology modeling: Corresponding residues in other C2c2 orthologs can be identified by the methods of Zhang et al., 2012 (Nature; 490(7421): 556-60) and Chen et al., 2015 (PLoS Comput Biol; 11(5): e1004248)—a computational protein-protein interaction (PPI) method to predict interactions mediated by domain-motif interfaces. PrePPI (Predicting PPI), a structure based PPI prediction method, combines structural evidence with non-structural evidence using a Bayesian statistical framework. The method involves taking

| | Set | | Sub-set | |
|---|---|---|---|---|
| Hydrophobic | F W Y H K M I L V A G C (SEQ ID NO: 48) | Aromatic | F W Y H (SEQ ID NO: 50) |
| | | Aliphatic | I L V |
| Polar | W Y H K R E D C S T N Q (SEQ ID NO: 49) | Charged | H K R E D (SEQ ID NO: 51) |
| | | Positively charged | H K R |
| | | Negatively charged | E D |
| Small | V C A G S P T N D (SEQ ID NO: 52) | Tiny | A G S |

Several aspects of the invention relate to vector systems comprising one or more vectors, or vectors as such. Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, yeast cells, or plant cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Embodiments of the invention include sequences (both polynucleotide or polypeptide) which may comprise homologous substitution (substitution and replacement are both used herein to mean the interchange of an existing amino acid residue or nucleotide, with an alternative residue a pair of query proteins and using structural alignment to identify structural representatives that correspond to either their experimentally determined structures or homology models. Structural alignment is further used to identify both close and remote structural neighbors by considering global and local geometric relationships. Whenever two neighbors of the structural representatives form a complex reported in the Protein Data Bank, this defines a template for modelling the interaction between the two query proteins. Models of the complex are created by superimposing the representative structures on their corresponding structural neighbor in the template. This approach is further described in Dey et al., 2013 (Prot Sci; 22: 359-66).

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of *E. coli* DNA polymerase, and reverse transcriptase. A preferred amplification method is PCR.

In certain aspects, the invention involves vectors. As used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. geminiviral vectors or vectors based on tobacco mosaic virus (TMV), potato virus X (PVX), alfalfa mosaic virus (AMV) and cucumber mosaic virus (CMV)). Viral vectors also include polynucleotides carried by a virus for transfection into a host cell. Certain vectors are capable of autonomous replication in a host cell into which they are introduced (e.g., bacterial vectors having a bacterial origin of replication). Other vectors are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids. In a preferred embodiment, vectors for expressing the CRISPR effector protein and the gRNA, for example as described in the Examples, can be combined via golden gate cloning and put into *Agrobacterium* vectors (based off pCAMBIA) for whole plant transformation or basic expression vectors for protoplasts.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

Aspects of the invention relate to bicistronic vectors for guide RNA and wild type, modified or mutated CRISPR effector proteins/enzymes (e.g. C2c2). Bicistronic expression vectors guide RNA and wild type, modified or mutated CRISPR effector proteins/enzymes (e.g. C2c2) are preferred. In general and particularly in this embodiment and wild type, modified or mutated CRISPR effector proteins/enzymes (e.g. C2c2) is preferably driven by the EF1a promoter. The RNA may preferably be driven by a Pol III promoter, such as a U6 promoter. Ideally the two are combined.

In some embodiments, a loop in the guide RNA is provided. This may be a stem loop or a tetra loop. The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol.

8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). Examples of regulatory elements in plants include, for example, light responsive elements (LREs) which may include, for example, a GTI-box (GGTTAA), an I-box (GATAAAGR), a G-box (CACGTG) and/or a H-box (ACCTA(A/C)C(A/C), auxin responsive elements (AuxREs) which may encompass the cis-acting motifs (G/T)GTCCCAT and/or TGTCTC, Gibberrellin-responsive elements (GAREs) including the GARE motifs TAACA(A/G); TATCCAC-box, and pyrimidine box (C/T)CTTTT(C/T); absiscic acid responsive elements (ABREs) such as the G-box (C/G/T)ACGTGGCG, ethylene responsive elements (EREs), sugar responsive elements (SUREs), heat stress responsive elements (HSEs), oxidative-stress responsive elements, cold-, drought-, and osmotic stress responsive elements, anaerobic-responsive elements (AREs), elements involved in seed specific expression such as for example RY-repeat motif, ACGT motif, E-box, AACA motif, GCN4 motif, and Prolamin-box; elements involved in fruit specific expression and others. More information in this regard can be found, for example, in Komarnytsky and Borisjuk, "Functional Analysis of promoter elements in plants", Genetic Engineering. Volume 25. It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Vectors can be designed for expression of CRISPR transcripts (e.g., nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or plant cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g., amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces cerivisae* include pYepSec1 (Baldari, et al., 1987. *EMBO J.* 6: 229-234), pMFa (Kuijan and Herskowitz, 1982. *Cell* 30: 933-943), pJRY88 (Schultz et al., 1987. *Gene* 54: 113-123), pYES2 (Invitrogen Corporation, San Diego, Calif.), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39).

In some embodiments, a vector is capable of driving expression of one or more sequences in plant cells. When used in plant cells, the expression vector's control functions are typically provided by one or more regulatory elements. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant plant expression vector is capable of directing expression of the nucleic acid preferentially in a particular cell type (e.g., tissue-specific regulatory elements are used to express the nucleic acid). Tissue-specific regulatory elements are known in the art.

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in *E. coli* (Ishino et al., J. Bacteriol., 169:5429-5433 [1987]; and Nakata et al., J. Bacteriol., 171:3553-3556 [1989]), and associated genes. Similar interspersed SSRs have been identified in *Haloferax mediterranei, Streptococcus pyogenes, Anabaena*, and *Mycobacterium tuberculosis*

(See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to *Aeropyrum, Pyrobaculum, Sulfolobus, Archaeoglobus, Halocarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema*, and *Thermotoga*.

In general, "RNA-targeting system" or "RNA-targeting system" as used in the present application refers collectively to transcripts and other elements involved in the expression of or directing the activity of RNA-targeting CRISPR-associated ("Cas") genes (also referred to herein as an effector protein), including sequences encoding a RNA-targeting Cas (effector) protein and a guide RNA (comprising crRNA sequence and where required a trans-activating CRISPR/Cas system RNA (tracrRNA) sequence), or other sequences and transcripts from a RNA-targeting CRISPR locus. In some embodiments, one or more elements of a RNA-targeting system is derived from a particular organism comprising an endogenous RNA-targeting CRISPR system. In general, a RNA-targeting system is characterized by elements that promote the formation of a RNA-targeting complex at the site of a target sequence. In the context of formation of a RNA-targeting complex, "target sequence" refers to a sequence to which a guide sequence is designed to have complementarity, where hybridization between a target sequence and a guide RNA promotes the formation of a RNA-targeting complex. Full complementarity is not necessarily required, provided there is sufficient complementarity to cause hybridization and promote formation of a RNA-targeting complex. A target sequence may comprise RNA polynucleotides. In some embodiments, a target sequence is located in the nucleus or cytoplasm of a cell. In some embodiments, the target sequence may be within an organelle of a eukaryotic cell, for example, mitochondrion or chloroplast. A sequence or template that may be used for recombination into the targeted locus comprising the target sequences is referred to as an "editing template" or "editing RNA" or "editing sequence". In aspects of the invention, an exogenous template RNA may be referred to as an editing template. In an aspect of the invention the recombination is homologous recombination.

Typically, in the context of an endogenous RNA-targeting system, formation of a RNA-targeting complex (comprising a guide RNA hybridized to a target sequence and complexed with one or more RNA-targeting effector proteins) results in cleavage of one or both RNA strands in or near (e.g. within 1, 2, 3, 4, 5, 6, 7, 8, 9, 10, 20, 50, or more base pairs from) the target sequence. In some embodiments, one or more vectors driving expression of one or more elements of a RNA-targeting system are introduced into a host cell such that expression of the elements of the RNA-targeting system direct formation of a RNA-targeting complex at one or more target sites. For example, a RNA-targeting effector protein and a guide RNA could each be operably linked to separate regulatory elements on separate vectors. Alternatively, two or more of the elements expressed from the same or different regulatory elements, may be combined in a single vector, with one or more additional vectors providing any components of the RNA-targeting system not included in the first vector. RNA-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a RNA-targeting effector protein and a guide RNA embedded within one or more intron sequences (e.g. each in a different intron, two or more in at least one intron, or all in a single intron). In some embodiments, the RNA-targeting effector protein and guide RNA are operably linked to and expressed from the same promoter.

In general, a guide sequence is any polynucleotide sequence having sufficient complementarity with a target polynucleotide sequence to hybridize with the target sequence and direct sequence-specific binding of a RNA-targeting complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a RNA-targeting complex to a target sequence may be assessed by any suitable assay. For example, the components of a RNA-targeting system sufficient to form a RNA-targeting complex, including the guide sequence to be tested, may be provided to a host cell having the corresponding target sequence, such as by transfection with vectors encoding the components of the RNA-targeting CRISPR sequence, followed by an assessment of preferential cleavage within or in the vicinity of the target sequence, such as by Surveyor assay. Similarly, cleavage of a target polynucleotide sequence (or a sequence in the vicinity thereof) may be evaluated in a test tube by providing the target sequence, components of a RNA-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art.

A guide sequence may be selected to target any target sequence. In some embodiments, the target sequence is a sequence within a gene transcript or mRNA.

In some embodiments, the target sequence is a sequence within a genome. In some embodiment the target sequence is a sequence within a genome of a plant RNA virus.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106(1): 23-24; and P A Carr and G M Church, 2009, *Nature Biotechnology* 27(12): 1151-62). Further algorithms may be found in U.S. application Ser. No. 61/836,080 filed Jun. 17, 2013; incorporated herein by reference.

In some embodiments, the RNA-targeting effector protein is part of a fusion protein comprising one or more heterologous protein domains (e.g., about or more than about 1, 2, 3, 4, 5, 6, 7, 8, 9, 10, or more domains in addition to the RNA-targeting effector protein). In some embodiments, the CRISPR effector protein/enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR effector protein/enzyme fusion protein may comprise any additional protein sequence, and optionally a linker sequence between any two domains. Examples of protein domains that may be fused to an effector protein include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and auto-fluorescent proteins including blue fluorescent protein (BFP). A RNA-targeting effector protein may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a RNA-targeting effector protein are described in US20110059502, incorporated herein by reference. In some embodiments, a tagged RNA-targeting effector protein is used to identify the location of a target sequence.

In some embodiments, a CRISPR protein may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome). In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736, 465 and U.S. 61/721,283 and WO 2014/018423 and U.S. Pat. Nos. 8,889,418, 8,895,308, US20140186919, US20140242700, US20140273234, US20140335620, WO2014093635, which is hereby incorporated by reference in its entirety.

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and organisms (such as plants) comprising or produced from such cells. In some embodiments, a RNA-targeting effector protein in combination with (and optionally complexed with) a guide RNA is delivered to a cell. Conventional viral and non-viral based gene transfer methods can be used to introduce nucleic acids in plant cells or target tissues. Such methods can be used to administer nucleic acids encoding components of a RNA-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and B6hm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid: nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™) Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids takes advantage of highly evolved processes for targeting a virus to specific cells in the organism and trafficking the viral payload to the nucleus. Viral vectors can be administered directly to an organism (in vivo) or they can be used to treat cells in vitro, and the modified cells may optionally be administered to an organism (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues. For plants, conventional viral based systems include geminiviral vectors such as vectors based on bean yellow dwarf virus (BYDW) or vectors based on tobacco mosaic virus (TMV), potato virus X (PVX), alfalfa mosaic virus (AMV) and cucumber mosaic virus (CMV).

Models of Genetic and Epigenetic Conditions

A method of the invention may be used to create a plant or cell that may be used to model and/or study genetic or epigenetic conditions of interest, such as a through a model of mutations of interest or a disease model. As used herein, "disease" refers to a disease, disorder, or indication in a plant. For example, a method of the invention may be used to create an plant or cell that comprises a modification in one or more nucleic acid sequences associated with a disease, or a plant or cell in which the expression of one or more nucleic acid sequences associated with a disease are altered. Such a nucleic acid sequence may encode a disease associated protein sequence or may be a disease associated control sequence. Thus, the invention provides a plant, produced by the present methods, or a progeny thereof. The progeny may be a clone of the produced plant or may result from sexual reproduction by crossing with other individuals of the same species to introgress further desirable traits into their offspring. The cell may be in vivo or ex vivo in the cases of multicellular organisms, particularly plants. In the instance where the cell is in cultured, a cell line may be established if appropriate culturing conditions are met and preferably if the cell is suitably adapted for this purpose (for instance a stem cell). Bacterial cell lines produced by the invention are also envisaged. Hence, cell lines are also envisaged.

In some methods, the disease model can be used to study the effects of mutations on the plant or cell and development and/or progression of the disease using measures commonly used in the study of the disease. Alternatively, such a disease model is useful for studying the effect of an active compound on the disease.

In some methods, the disease model can be used to assess the efficacy of a potential gene therapy strategy. That is, a disease-associated gene or polynucleotide can be modified such that the disease development and/or progression is inhibited or reduced. In particular, the method comprises modifying a disease-associated gene or polynucleotide such that an altered protein is produced and, as a result, the plant or cell has an altered response. Accordingly, in some methods, a genetically modified plant may be compared with plant predisposed to development of the disease such that the effect of the gene therapy event may be assessed.

In another embodiment, this invention provides a method of developing a biologically active agent that modulates a cell signaling event associated with a disease gene. The method comprises contacting a test compound with a cell comprising one or more vectors that drive expression of one or more of a CRISPR enzyme, and a direct repeat sequence linked to a guide sequence; and detecting a change in a readout that is indicative of a reduction or an augmentation of a cell signaling event associated with, e.g., a mutation in a disease gene contained in the cell.

A cell model or plant model can be constructed in combination with the method of the invention for screening a cellular function change. Such a model may be used to study the effects of a genome sequence modified by the CRISPR complex of the invention on a cellular function of interest. For example, a cellular function model may be used to study the effect of a modified target sequence on intracellular signaling or extracellular signaling. Alternatively, a cellular function model may be used to study the effects of a modified sequence on sensory perception. In some such models, one or more target sequences associated with a signaling biochemical pathway in the model are modified.

An altered expression of one or more target sequences associated with a signalling biochemical pathway can be determined by assaying for a difference in the levels of the corresponding target RNAs between the test model cell and a control cell, when they are contacted with a candidate agent. Alternatively, the differential expression of the sequences associated with a signaling biochemical pathway is determined by detecting a difference in the level of the encoded polypeptide.

To assay for an agent-induced alteration in the level of mRNA transcripts or corresponding polynucleotides, nucleic acid contained in a sample is first extracted according to standard methods in the art. For instance, mRNA can be isolated using various lytic enzymes or chemical solutions according to the procedures set forth in Sambrook et al. (1989), or extracted by nucleic-acid-binding resins following the accompanying instructions provided by the manufacturers. The mRNA contained in the extracted nucleic acid sample is then detected by amplification procedures or conventional hybridization assays (e.g. Northern blot analysis) according to methods widely known in the art or based on the methods exemplified herein.

For purpose of this invention, amplification means any method employing a primer and a polymerase capable of replicating a target sequence with reasonable fidelity. Amplification may be carried out by natural or recombinant DNA polymerases such as TaqGold™, T7 DNA polymerase, Klenow fragment of E. coli DNA polymerase, and reverse transcriptase. A preferred amplification method is PCR. In particular, the isolated RNA can be subjected to a reverse transcription assay that is coupled with a quantitative polymerase chain reaction (RT-PCR) in order to quantify the expression level of a sequence associated with a signaling biochemical pathway.

Detection of the gene expression level can be conducted in real time in an amplification assay. In one aspect, the amplified products can be directly visualized with fluorescent DNA-binding agents including but not limited to DNA intercalators and DNA groove binders. Because the amount of the intercalators incorporated into the double-stranded DNA molecules is typically proportional to the amount of the amplified DNA products, one can conveniently determine the amount of the amplified products by quantifying the fluorescence of the intercalated dye using conventional optical systems in the art. DNA-binding dye suitable for this application include SYBR green, SYBR blue, DAPI, propidium iodine, Hoeste, SYBR gold, ethidium bromide, acridines, proflavine, acridine orange, acriflavine, fluorcoumanin, ellipticine, daunomycin, chloroquine, distamycin D, chromomycin, homidium, mithramycin, ruthenium polypyridyls, anthramycin, and the like.

In another aspect, other fluorescent labels such as sequence specific probes can be employed in the amplification reaction to facilitate the detection and quantification of the amplified products. Probe-based quantitative amplification relies on the sequence-specific detection of a desired amplified product. It utilizes fluorescent, target-specific probes (e.g., TaqMan® probes) resulting in increased specificity and sensitivity. Methods for performing probe-based quantitative amplification are well established in the art and are taught in U.S. Pat. No. 5,210,015.

In yet another aspect, conventional hybridization assays using hybridization probes that share sequence homology with sequences associated with a signaling biochemical pathway can be performed. Typically, probes are allowed to form stable complexes with the sequences associated with a signaling biochemical pathway contained within the biological sample derived from the test subject in a hybridization reaction. It will be appreciated by one of skill in the art that where antisense is used as the probe nucleic acid, the target polynucleotides provided in the sample are chosen to be complementary to sequences of the antisense nucleic acids. Conversely, where the nucleotide probe is a sense nucleic acid, the target polynucleotide is selected to be complementary to sequences of the sense nucleic acid.

Hybridization can be performed under conditions of various stringency. Suitable hybridization conditions for the practice of the present invention are such that the recognition interaction between the probe and sequences associated with a signaling biochemical pathway is both sufficiently specific and sufficiently stable. Conditions that increase the stringency of a hybridization reaction are widely known and published in the art. See, for example, (Sambrook, et al., (1989); Nonradioactive In Situ Hybridization Application Manual, Boehringer Mannheim, second edition). The hybridization assay can be formed using probes immobilized on any solid support, including but are not limited to nitrocellulose, glass, silicon, and a variety of gene arrays. A preferred hybridization assay is conducted on high-density gene chips as described in U.S. Pat. No. 5,445,934.

For a convenient detection of the probe-target complexes formed during the hybridization assay, the nucleotide probes are conjugated to a detectable label. Detectable labels suitable for use in the present invention include any composition detectable by photochemical, biochemical, spectroscopic, immunochemical, electrical, optical or chemical means. A wide variety of appropriate detectable labels are known in the art, which include fluorescent or chemiluminescent labels, radioactive isotope labels, enzymatic or other ligands. In preferred embodiments, one will likely desire to employ a fluorescent label or an enzyme tag, such as digoxigenin, β-galactosidase, urease, alkaline phosphatase or peroxidase, avidin/biotin complex.

The detection methods used to detect or quantify the hybridization intensity will typically depend upon the label selected above. For example, radiolabels may be detected using photographic film or a phosphoimager. Fluorescent markers may be detected and quantified using a photodetector to detect emitted light. Enzymatic labels are typically detected by providing the enzyme with a substrate and measuring the reaction product produced by the action of the enzyme on the substrate; and finally colorimetric labels are detected by simply visualizing the colored label.

An agent-induced change in expression of sequences associated with a signaling biochemical pathway can also be determined by examining the corresponding gene products. Determining the protein level typically involves a) contacting the protein contained in a biological sample with an agent that specifically bind to a protein associated with a signaling biochemical pathway; and (b) identifying any agent:protein complex so formed. In one aspect of this embodiment, the agent that specifically binds a protein associated with a signaling biochemical pathway is an antibody, preferably a monoclonal antibody.

The reaction is performed by contacting the agent with a sample of the proteins associated with a signaling biochemical pathway derived from the test samples under conditions that will allow a complex to form between the agent and the proteins associated with a signaling biochemical pathway. The formation of the complex can be detected directly or indirectly according to standard procedures in the art. In the direct detection method, the agents are supplied with a detectable label and unreacted agents may be removed from the complex; the amount of remaining label thereby indicating the amount of complex formed. For such method, it is preferable to select labels that remain attached to the agents even during stringent washing conditions. It is preferable that the label does not interfere with the binding reaction. In the alternative, an indirect detection procedure may use an agent that contains a label introduced either chemically or enzymatically. A desirable label generally does not interfere with binding or the stability of the resulting agent:polypeptide complex. However, the label is typically designed to be accessible to an antibody for an effective binding and hence generating a detectable signal.

A wide variety of labels suitable for detecting protein levels are known in the art. Non-limiting examples include radioisotopes, enzymes, colloidal metals, fluorescent compounds, bioluminescent compounds, and chemiluminescent compounds.

The amount of agent:polypeptide complexes formed during the binding reaction can be quantified by standard quantitative assays. As illustrated above, the formation of agent:polypeptide complex can be measured directly by the amount of label remained at the site of binding. In an alternative, the protein associated with a signaling biochemical pathway is tested for its ability to compete with a labeled analog for binding sites on the specific agent. In this competitive assay, the amount of label captured is inversely proportional to the amount of protein sequences associated with a signaling biochemical pathway present in a test sample.

A number of techniques for protein analysis based on the general principles outlined above are available in the art. They include but are not limited to radioimmunoassays, ELISA (enzyme linked immunoradiometric assays), "sandwich" immunoassays, immunoradiometric assays, in situ immunoassays (using e.g., colloidal gold, enzyme or radioisotope labels), western blot analysis, immunoprecipitation assays, immunofluorescent assays, and SDS-PAGE.

Antibodies that specifically recognize or bind to proteins associated with a signaling biochemical pathway are preferable for conducting the aforementioned protein analyses. Where desired, antibodies that recognize a specific type of post-translational modifications (e.g., signaling biochemical pathway inducible modifications) can be used. Post-translational modifications include but are not limited to glycosylation, lipidation, acetylation, and phosphorylation. These antibodies may be purchased from commercial vendors. For example, anti-phosphotyrosine antibodies that specifically recognize tyrosine-phosphorylated proteins are available from a number of vendors including Invitrogen and Perkin Elmer.

Antiphosphotyrosine antibodies are particularly useful in detecting proteins that are differentially phosphorylated on their tyrosine residues in response to an ER stress. Such proteins include but are not limited to eukaryotic translation initiation factor 2 alpha (eIF-2a). Alternatively, these antibodies can be generated using conventional polyclonal or monoclonal antibody technologies by immunizing a host animal or an antibody-producing cell with a target protein that exhibits the desired post-translational modification.

In practicing the subject method, it may be desirable to discern the expression pattern of an protein associated with a signaling biochemical pathway in different bodily tissue, in different cell types, and/or in different subcellular structures. These studies can be performed with the use of tissue-specific, cell-specific or subcellular structure specific antibodies capable of binding to protein markers that are preferentially expressed in certain tissues, cell types, or subcellular structures.

An altered expression of a gene associated with a signaling biochemical pathway can also be determined by examining a change in activity of the gene product relative to a control cell. The assay for an agent-induced change in the activity of a protein associated with a signaling biochemical pathway will dependent on the biological activity and/or the signal transduction pathway that is under investigation. For example, where the protein is a kinase, a change in its ability to phosphorylate the downstream substrate(s) can be determined by a variety of assays known in the art. Representative assays include but are not limited to immunoblotting and immunoprecipitation with antibodies such as anti-phosphotyrosine antibodies that recognize phosphorylated proteins. In addition, kinase activity can be detected by high throughput chemiluminescent assays such as AlphaScreen™ (available from Perkin Elmer) and eTag™ assay (Chan-Hui, et al. (2003) Clinical Immunology 111: 162-174).

Where the protein associated with a signaling biochemical pathway is part of a signaling cascade leading to a fluctuation of intracellular pH condition, pH sensitive molecules such as fluorescent pH dyes can be used as the reporter molecules. In another example where the protein associated with a signaling biochemical pathway is an ion channel, fluctuations in membrane potential and/or intracellular ion concentration can be monitored. A number of commercial kits and high-throughput devices are particularly suited for a rapid and robust screening for modulators of ion channels. Representative instruments include FLIPR™ (Molecular Devices, Inc.) and VIPR (Aurora Biosciences). These instruments are capable of detecting reactions in over 1000 sample wells of a microplate simultaneously, and providing real-time measurement and functional data within a second or even a minisecond.

In practicing any of the methods disclosed herein, a suitable vector can be introduced to a cell or an embryo via one or more methods known in the art, including without limitation, microinjection, electroporation, sonoporation, biolistics, calcium phosphate-mediated transfection, cationic transfection, liposome transfection, dendrimer transfection, heat shock transfection, nucleofection transfection, magnetofection, lipofection, impalefection, optical transfection, proprietary agent-enhanced uptake of nucleic acids, and delivery via liposomes, immunoliposomes, virosomes, or artificial virions. In some methods, the vector is introduced into an embryo by microinjection. The vector or vectors may be microinjected into the nucleus or the cytoplasm of the embryo. In some methods, the vector or vectors may be introduced into a cell by nucleofection.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide).

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide). Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence) Examples of PAM sequences are given in the examples section below, and the skilled person will be able to identify further PAM sequences for use with a given CRISPR enzyme.

The target polynucleotide of a CRISPR complex may include a number of disease associated genes and polynucleotides as well as signaling biochemical pathway-associated genes and polynucleotides as listed in U.S. provisional patent applications 61/736,527 and 61/748,427 both entitled SYSTEMS METHODS AND COMPOSITIONS FOR SEQUENCE MANIPULATION filed on Dec. 12, 2012 and Jan. 2, 2013, respectively, and PCT Application PCT/

US2013/074667, entitled DELIVERY, ENGINEERING AND OPTIMIZATION OF SYSTEMS, METHODS AND COMPOSITIONS FOR SEQUENCE MANIPULATION AND THERAPEUTIC APPLICATIONS, filed Dec. 12, 2013, the contents of all of which are herein incorporated by reference in their entirety.

Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level.

Transcriptome Wide Knock-Down Screening

The CRISPR effector protein complexes described herein can be used to perform efficient and cost effective functional transcriptomic screens. Such screens can utilize CRISPR effector protein based transcriptome wide libraries. Such screens and libraries can provide for determining the function of genes, cellular pathways genes are involved in, and how any alteration in gene expression can result in a particular biological process. An advantage of the present invention is that the CRISPR system avoids off-target binding and its resulting side effects. This is achieved using systems arranged to have a high degree of sequence specificity for the target RNA. In preferred embodiments of the invention, the CRISPR effector protein complexes are C2c2 effector protein complexes.

In embodiments of the invention, a transcriptome wide library may comprise a plurality of C2c2 guide RNAs, as described herein, comprising guide sequences that are capable of targeting a plurality of target sequences in a plurality of loci in a population of eukaryotic cells. The population of cells may be a population of embryonic stem (ES) cells. The target sequence in the locus may be a non-coding sequence. The non-coding sequence may be an intron, regulatory sequence, splice site, 3' UTR, 5' UTR, or polyadenylation signal. Gene function of one or more gene products may be altered by said targeting. The targeting may result in a knockdown of gene function. The targeting of a gene product may comprise more than one guide RNA. A gene product may be targeted by 2, 3, 4, 5, 6, 7, 8, 9, or 10 guide RNAs, preferably 3 to 4 per gene. Off-target modifications may be minimized by exploiting the staggered double strand breaks generated by C2c2 effector protein complexes or by utilizing methods analogous to those used in CRISPR-Cas9 systems (See, e.g., DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013)), incorporated herein by reference. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the invention comprehends a transcriptome wide library that may comprise a plurality of C2c2 guide RNAs that may comprise guide sequences that are capable of targeting a plurality of target sequences in a plurality of loci, wherein said targeting results in a knockdown of gene function. This library may potentially comprise guide RNAs that target RNAs from each and every gene in the genome of an organism.

In some embodiments of the invention the organism or subject is a eukaryote, in particular a plant. In some methods of the invention the organism or subject is algae, including microalgae, or is a fungus.

The knockdown of gene function may comprise: introducing into each cell in the population of cells a vector system of one or more vectors comprising an engineered, non-naturally occurring C2c2 effector protein system comprising I. a C2c2 effector protein, and II. one or more guide RNAs, wherein components I and II may be same or on different vectors of the system, integrating components I and II into each cell, wherein the guide sequence targets a target RNA from a unique gene in each cell, wherein the C2c2 effector protein is operably linked to a regulatory element, wherein when transcribed, the guide RNA comprising the guide sequence directs sequence-specific binding of the C2c2 effector protein system to a target sequence in the genomic loci of the unique gene, inducing cleavage of the genomic loci by the C2c2 effector protein, and confirming different knockdown events in a plurality of unique genes in each cell of the population of cells thereby generating a gene knockdown cell library.

The one or more vectors may be plasmid vectors. The vector may be a single vector comprising a C2c2 effector protein, a sgRNA, and optionally, a selection marker into target cells. Not being bound by a theory, the ability to simultaneously deliver a C2c2 effector protein and sgRNA through a single vector enables application to any cell type of interest, without the need to first generate cell lines that express the C2c2 effector protein. The regulatory element may be an inducible promoter. The inducible promoter may be a doxycycline inducible promoter. In some methods of the invention the expression of the guide sequence is under the control of the T7 promoter and is driven by the expression of T7 polymerase. The confirming of different knockdown events may be by whole transcriptome sequencing. The knockdown event may be achieved in 100 or more unique genes. The knockdown event may be achieved in 1000 or more unique genes. The knockdown event may be achieved in 20,000 or more unique genes. The knockdown event may be achieved in the entire transcriptome. The knockdown of gene function may be achieved in a plurality of unique genes which function in a particular physiological pathway or condition. The pathway or condition may be an immune pathway or condition. The pathway or condition may be a cell division pathway or condition.

The invention also provides kits that comprise the transcriptome wide libraries mentioned herein. The kit may comprise a single container comprising vectors or plasmids comprising the library of the invention. The kit may also comprise a panel comprising a selection of unique C2c2 effector protein system guide RNAs comprising guide sequences from the library of the invention, wherein the selection is indicative of a particular physiological condition. The invention comprehends that the targeting is of about 100 or more sequences, about 1000 or more sequences or about 20,000 or more sequences or the entire transcriptome. Furthermore, a panel of target sequences may be focused on a relevant or desirable pathway, such as an immune pathway or cell division.

In an additional aspect of the invention, the C2c2 effector protein may comprise one or more mutations and may be used as a generic RNA binding protein with or without fusion to a functional domain. The mutations may be artificially introduced mutations or gain- or loss-of-function mutations. The mutations have been characterized as described herein. In one aspect of the invention, the functional domain may be a transcriptional activation domain, which may be VP64. In other aspects of the invention, the functional domain may be a transcriptional repressor domain, which may be KRAB or SID4X. Other aspects of the invention relate to the mutated C2c2 effector protein being fused to domains which include but are not limited to a transcriptional activator, repressor, a recombinase, a transposase, a histone remodeler, a demethylase, a DNA methyltransferase, a cryptochrome, a light inducible/controllable domain or a chemically inducible/controllable domain. Some methods of the invention can include inducing expression of targeted RNAs. In one embodiment, inducing expression by targeting a plurality of target sequences in a plurality of genomic loci in a population of eukaryotic cells is by use of a functional domain.

Useful in the practice of the instant invention utilizing C2c2 effector protein complexes are methods used in CRISPR-Cas9 systems and reference is made to:

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science Dec. 12, 2013. [Epub ahead of print]; Published in final edited form as: Science. 2014 Jan. 3; 343(6166): 84-87.

Shalem et al. involves a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NFL and MED12 as well as novel hitsNF2, CUL3, TADA2B, and TADA1. The authors observed a high level of consistency between independent guide RNAs targeting the same gene and a high rate of hit confirmation, and thus demonstrated the promise of genome-scale screening with Cas9.

Reference is also made to US patent publication number US20140357530; and PCT Patent Publication WO2014093701, hereby incorporated herein by reference.

Transcript Detection Methods

The effector proteins and systems of the invention are useful for specific detection of RNAs in a cell or other sample. In the presence of an RNA target of interest, guide-dependent C2c2 nuclease activity may be accompanied by non-specific RNAse activity against collateral targets. To take advantage of the RNase activity, all that is needed is a reporter substrate that can be detectably cleaved. For example, a reporter molecule can comprise RNA, tagged with a fluorescent reporter molecule (fluor) on one end and a quencher on the other. In the absence of C2c2 RNase activity, the physical proximity of the quencher dampens fluorescence from the fluor to low levels. When C2c2 target specific cleavage is activated by the presence of an RNA target-of-interest and suitable guide RNA, the RNA-containing reporter molecule is non-specifically cleaved and the fluor and quencher are spatially separated. This causes the fluor to emit a detectable signal when excited by light of the appropriate wavelength.

In one exemplary assay method, C2c2 effector, target-of-interest-specific guide RNA, and reporter molecule are added to a cellular sample. An increase in fluorescence indicates the presence of the RNA target-of-interest. In another exemplary method, a detection array is provided. Each location of the array is provided with C2c2 effector, reporter molecule, and a target-of-interest-specific guide RNA. Depending on the assay to be performed, the target-of-interest-specific guide RNAs at each location of the array can be the same, different, or a combination thereof. Different target-of-interest-specific guide RNAs might be provided, for example when it is desired to test for one or more targets in a single source sample. The same target-of-interest-specific guide RNA might be provided at each location, for example when it is desired to test multiple samples for the same target.

Functional Alteration and Screening

In another aspect, the present invention provides for a method of functional evaluation and screening of genes. The use of the CRISPR system of the present invention to precisely deliver functional domains, to activate or repress genes or to alter epigenetic state by precisely altering the methylation site on a specific sequence, can be with one or more guide RNAs applied to a single cell or population of cells or with a library applied to genome in a pool of cells ex vivo or in vivo comprising the administration or expression of a library comprising a plurality of guide RNAs (sgRNAs) and wherein the screening further comprises use of a C2c2 effector protein, wherein the CRISPR complex comprising the C2c2 effector protein is modified to comprise a heterologous functional domain. In an aspect the invention provides a method for screening a genome/transcriptome comprising the administration to a host or expression in a host in vivo of a library. In an aspect the invention provides a method as herein discussed further comprising an activator administered to the host or expressed in the host. In an aspect the invention provides a method as herein discussed wherein the activator is attached to a C2c2 effector protein. In an aspect the invention provides a method as herein discussed wherein the activator is attached to the N terminus or the C terminus of the C2c2 effector protein. In an aspect the invention provides a method as herein discussed wherein the activator is attached to a sgRNA loop. In an aspect the invention provides a method as herein discussed further comprising a repressor administered to the host or expressed in the host. In an aspect the invention provides a method as herein discussed, wherein the screening comprises affecting and detecting gene activation, gene inhibition, or cleavage in the locus.

In an aspect, the invention provides efficient on-target activity and minimizes off target activity. In an aspect, the invention provides efficient on-target cleavage by C2c2 effector protein and minimizes off-target cleavage by the C2c2 effector protein. In an aspect, the invention provides guide specific binding of C2c2 effector protein at a target sequence without RNA cleavage. Accordingly, in an aspect, the invention provides target-specific gene regulation. In an aspect, the invention provides guide specific binding of C2c2 effector protein at a target sequence without RNA cleavage. Accordingly, in an aspect, the invention provides for cleavage at one target sequence and gene regulation at a different locus using a single C2c2 effector protein. In an aspect, the invention provides orthogonal activation and/or inhibition and/or cleavage of multiple targets using one or more C2c2 effector protein and/or enzyme.

In an aspect the invention provides a method as herein discussed, wherein the host is a eukaryotic cell. In an aspect the invention provides a method as herein discussed, wherein the host is a plant cell. In an aspect the invention provides a method as herein discussed, wherein the host is a plant. An aspect the invention provides a method as herein discussed comprising the delivery of the C2c2 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein discussed wherein the expressing in vivo is via a plant virus such as a viral vector comprising the backbone of a Tobacco mosaic virus (TMV), Potato virus X (PVX), Cowpea mosaic virus (CPMV), or of the DNA geminivirus Bean yellow dwarf virus. The viral vector can be delivederd to a plant, for example by sparying the plant with viral particles or by deliverying a full or deconstructed virus to the plant by a bacterium such as *Agrobacterium*. In a preferred embodiment, by the viral vector is delivered to the plant by agrobacterial T-DNA transfer (magnifection). In an aspect the invention provides a method as herein discussed wherein the delivery is via a particle, a nanoparticle, a lipid or a cell penetrating peptide (CPP).

In an aspect the invention provides a pair of CRISPR complexes comprising C2c2 effector protein, each comprising a guide RNA (sgRNA) comprising a guide sequence capable of hybridizing to a target sequence in a genomic locus of interest in a cell, wherein at least one loop of each sgRNA is modified by the insertion of distinct RNA sequence(s) that bind to one or more adaptor proteins, and wherein the adaptor protein is associated with one or more functional domains, wherein each sgRNA of each C2c2 effector protein complex comprises a functional domain having a DNA cleavage activity.

In an aspect the invention provides a method for cutting a target sequence in a sequence comprising delivery to a cell of the C2c2 effector protein complexes or component(s) thereof or nucleic acid molecule(s) coding therefor, wherein said nucleic acid molecule(s) are operatively linked to regulatory sequence(s) and expressed in vivo. In an aspect the invention provides a method as herein-discussed wherein the delivery is via plant virus such as via a geminiviral vector.

In an aspect the invention provides a library, method or complex as herein-discussed wherein the sgRNA is modified to have at least one non-coding functional loop, e.g., wherein the at least one non-coding functional loop is repressive; for instance, wherein the at least one non-coding functional loop comprises Alu.

In one aspect, the invention provides a method for altering or modifying expression of a gene product. The said method may comprise introducing into a cell containing and expressing a RNA molecule encoding the gene product an engineered, non-naturally occurring CRISPR system comprising a C2c2 effector protein and guide RNA that targets the RNA molecule, whereby the guide RNA targets the RNA target molecule encoding the gene product and the C2c2 effector protein cleaves the RNA molecule encoding the gene product, whereby expression of the gene product is altered; and, wherein the C2c2 effector protein and the guide RNA do not naturally occur together. The invention comprehends the guide RNA comprising a guide sequence linked to a direct repeat sequence. The invention further comprehends the C2c2 effector protein being codon optimized for expression in a eukaryotic cell. In a preferred embodiment the eukaryotic cell is a plant cell. In a further embodiment of the invention, the expression of the gene product is decreased.

In some embodiments, one or more functional domains are associated with the C2c2 effector protein. In some embodiments, one or more functional domains are associated with an adaptor protein, for example as used with the modified guides of Konnerman et al. (Nature 517, 583-588, 29 Jan. 2015). In some embodiments, one or more functional domains are associated with an dead sgRNA (dRNA). In some embodiments, a dRNA complex with active C2c2 effector protein directs gene regulation by a functional domain at on gene locus while an sgRNA directs RNA cleavage by the active C2c2 effector protein at another locus, for example as described analogously in CRISPR-Cas9 systems by Dahlman et al., 'Orthogonal gene control with a catalytically active Cas9 nuclease' (in press). In some embodiments, dRNAs are selected to maximize selectivity of regulation for a gene locus of interest compared to off-target regulation. In some embodiments, dRNAs are selected to maximize target gene regulation and minimize target cleavage For the purposes of the following discussion, reference to a functional domain could be a functional domain associated with the C2c2 effector protein or a functional domain associated with the adaptor protein.

In some embodiments, the one or more functional domains is an NLS (Nuclear Localization Sequence) or an NES (Nuclear Export Signal). In some embodiments, the one or more functional domains is a transcriptional activation domain comprises VP64, p65, MyoD1, HSF1, RTA, SET7/9 and a histone acetyltransferase. Other references herein to activation (or activator) domains in respect of those associated with the CRISPR enzyme include any known transcriptional activation domain and specifically VP64, p65, MyoD1, HSF1, RTA, SET7/9 or a histone acetyltransferase.

In some embodiments, the one or more functional domains is a transcriptional repressor domain. In some embodiments, the transcriptional repressor domain is a KRAB domain. In some embodiments, the transcriptional repressor domain is a NuE domain, NcoR domain, SID domain or a SID4X domain.

In some embodiments, the one or more functional domains have one or more activities comprising translation activation activity, translation repression activity, methylase activity, demethylase activity, transcription activation activity, transcription repression activity, transcription release factor activity, histone modification activity, RNA cleavage activity, DNA cleavage activity, DNA integration activity or nucleic acid binding activity.

In some embodiments, the DNA cleavage activity is due to a nuclease. In some embodiments, the nuclease comprises a Fok1 nuclease. See, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In some embodiments, the one or more functional domains is attached to the C2c2 effector protein so that upon binding to the sgRNA and target the functional domain is in a spatial orientation allowing for the functional domain to function in its attributed function.

In some embodiments, the one or more functional domains is attached to the adaptor protein so that upon binding of the C2c2 effector protein to the sgRNA and target, the functional domain is in a spatial orientation allowing for the functional domain to function in its attributed function.

In an aspect the invention provides a composition as herein discussed wherein the one or more functional domains is attached to the C2c2 effector protein or adaptor protein via a linker, optionally a GlySer linker, as discussed herein.

It is also preferred to target endogenous (regulatory) control elements, such as involved in translation, stability, etc. Targeting of known control elements can be used to activate or repress the gene of interest. Targeting of putative control elements on the other hand can be used as a means to verify such elements (by measuring the translation of the gene of interest) or to detect novel control elements. In addition, targeting of putative control elements can be useful in the context of understanding genetic causes of disease. Many mutations and common SNP variants associated with disease phenotypes are located outside coding regions. Targeting of such regions with either the activation or repression systems described herein can be followed by readout of transcription of either a) a set of putative targets (e.g. a set of genes located in closest proximity to the control element) or b) whole-transcriptome readout by e.g. RNAseq or microarray. This would allow for the identification of likely candidate genes involved in the disease phenotype. Such candidate genes could be useful as novel drug targets.

Histone acetyltransferase (HAT) inhibitors are mentioned herein. However, an alternative in some embodiments is for the one or more functional domains to comprise an acetyltransferase, preferably a histone acetyltransferase. These are useful in the field of epigenomics, for example in methods of interrogating the epigenome. Methods of interrogating the epigenome may include, for example, targeting epigenomic sequences. Targeting epigenomic sequences may include the guide being directed to an epigenomic target sequence. Epigenomic target sequence may include, in some embodiments, include a promoter, silencer or an enhancer sequence.

Use of a functional domain linked to a C2c2 effector protein as described herein, preferably a dead-C2c2 effector protein, more preferably a dead-FnC2c2 effector protein, to target epigenomic sequences can be used to activate or repress promoters, silencer or enhancers.

Examples of acetyltransferases are known but may include, in some embodiments, histone acetyltransferases. In some embodiments, the histone acetyltransferase may comprise the catalytic core of the human acetyltransferase p300 (Gerbasch & Reddy, Nature Biotech 6th April 2015).

In some preferred embodiments, the functional domain is linked to a dead-C2c2 effector protein to target and activate epigenomic sequences such as promoters or enhancers. One or more guides directed to such promoters or enhancers may also be provided to direct the binding of the CRISPR enzyme to such promoters or enhancers.

In certain embodiments, the RNA targeting effector protein of the invention can be used to interfere with co-transcriptional modifications of DNA/chromatin structure, RNA-directed DNA methylation, or RNA-directed silencing/activation of DNA/chromatin. RNA-directed DNA methylation (RdDM) is an epigenetic process first discovered in plants. During RdDM, double-stranded RNAs (dsRNAs) are processed to 21-24 nucleotide small interfering RNAs (siRNAs) and guide methylation of homologous DNA loci. Besides RNA molecules, a plethora of proteins are involved in the establishment of RdDM, like Argonautes, DNA methyltransferases, chromatin remodelling complexes and the plant-specific PolIV and PolV. All these act in concert to add a methyl-group at the 5' position of cytosines. Small RNAs can modify the chromatin structure and silence transcription by guiding Argonaute-containing complexes to complementary nascent (non-coding) RNA trancripts. Subsequently the recruitment of chromatin-modifying complexes, including histone and DNA methyltransferases, is mediated. The RNA targeting effector protein of the invention may be used to target such small RNAs and interfere in interactions between these small RNAs and the nascent non-coding transcripts.

The term "associated with" is used here in relation to the association of the functional domain to the C2c2 effector protein or the adaptor protein. It is used in respect of how one molecule 'associates' with respect to another, for example between an adaptor protein and a functional domain, or between the C2c2 effector protein and a functional domain. In the case of such protein-protein interactions, this association may be viewed in terms of recognition in the way an antibody recognizes an epitope. Alternatively, one protein may be associated with another protein via a fusion of the two, for instance one subunit being fused to another subunit. Fusion typically occurs by addition of the amino acid sequence of one to that of the other, for instance via splicing together of the nucleotide sequences that encode each protein or subunit. Alternatively, this may essentially be viewed as binding between two molecules or direct linkage, such as a fusion protein. In any event, the fusion protein may include a linker between the two subunits of interest (i.e. between the enzyme and the functional domain or between the adaptor protein and the functional domain). Thus, in some embodiments, the C2c2 effector protein or adaptor protein is associated with a functional domain by binding thereto. In other embodiments, the C2c2 effector protein or adaptor protein is associated with a functional domain because the two are fused together, optionally via an intermediate linker.

Saturating Mutagenesis

The C2c2 effector protein system(s) described herein can be used to perform saturating or deep scanning mutagenesis of target sequences in conjunction with a cellular phenotype—for instance, for determining critical minimal features and discrete vulnerabilities of functional elements required for gene expression, drug resistance, and reversal of disease. By saturating or deep scanning mutagenesis is meant that every or essentially every RNA base is cut within the target sequences. A library of C2c2 effector protein guide RNAs may be introduced into a population of cells. The library may be introduced, such that each cell receives a single guide RNA (sgRNA). In the case where the library is introduced by transduction of a viral vector, as described herein, a low multiplicity of infection (MOI) is used. The library may include sgRNAs targeting every sequence upstream of a (protospacer adjacent motif) (PAM) sequence in a genomic locus. The library may include at least 100 non-overlapping target sequences upstream of a PAM sequence for every 1000 base pairs within the target sequence. The library may include sgRNAs targeting sequences upstream of at least one different PAM sequence.

The C2c2 effector protein systems may include more than one C2c2 protein. Any C2c2 effector protein as described herein, including orthologues or engineered C2c2 effector proteins that recognize different PAM sequences may be used. The frequency of off target sites for a sgRNA may be less than 500. Off target scores may be generated to select sgRNAs with the lowest off target sites. Any phenotype determined to be associated with cutting at a sgRNA target site may be confirmed by using sgRNAs targeting the same site in a single experiment. Validation of a target site may also be performed by using a modified C2c2 effector protein, as described herein, and two sgRNAs targeting the genomic site of interest. Not being bound by a theory, a target site is a true hit if the change in phenotype is observed in validation experiments.

The C2c2 effector protein system(s) for saturating or deep scanning mutagenesis can be used in a population of cells. The C2c2 effector protein system(s) can be used in eukaryotic cells, including but not limited to plant cells. The population of cells may be prokaryotic cells. The population of eukaryotic cells may be a population of plant cells or yeast cells.

In one aspect, the present invention provides for a method of screening for functional elements associated with a change in a phenotype. The library may be introduced into a population of cells that are adapted to contain a C2c2 effector protein. The cells may be sorted into at least two groups based on the phenotype. The phenotype may be expression of a gene, cell growth, or cell viability. The relative representation of the guide RNAs present in each group are determined, whereby genomic sites associated with the change in phenotype are determined by the representation of guide RNAs present in each group. The change in phenotype may be a change in expression of a gene of interest. The gene of interest may be upregulated, downregulated, or knocked out. The cells may be sorted into a high expression group and a low expression group. The population of cells may include a reporter construct that is used to determine the phenotype. The reporter construct may include a detectable marker. Cells may be sorted by use of the detectable marker.

In another aspect, the present invention provides for a method of screening for loci associated with resistance to a chemical compound. The chemical compound may be a drug or pesticide. The library may be introduced into a population of cells that are adapted to contain a C2c2 effector protein, wherein each cell of the population contains no more than one guide RNA; the population of cells are treated with the chemical compound; and the representation of guide RNAs are determined after treatment with the chemical compound at a later time point as compared to an early time point, whereby genomic sites associated with resistance to the chemical compound are determined by enrichment of guide RNAs. Representation of sgRNAs may be determined by deep sequencing methods.

Useful in the practice of the instant invention utilizing C2c2 effector protein complexes are methods used in CRISPR-Cas9 systems and reference is made to the article entitled BCL11A enhancer dissection by Cas9-mediated in situ saturating mutagenesis. Canver, M. C., Smith, E. C., Sher, F., Pinello, L., Sanjana, N. E., Shalem, O., Chen, D. D., Schupp, P. G., Vinjamur, D. S., Garcia, S. P., Luc, S., Kurita, R., Nakamura, Y., Fujiwara, Y., Maeda, T., Yuan, G., Zhang, F., Orkin, S. H., & Bauer, D. E. DOI:10.1038/nature15521, published online Sep. 16, 2015, the article is herein incorporated by reference and discussed briefly below:

Method of Using C2c2 Systems to Modify a Cell or Organism

The invention in some embodiments comprehends a method of modifying a cell or organism. The cell may be a prokaryotic cell or a eukaryotic cell. The cell may be a plant cell. The plant cell may be of a crop plant such as cassava, corn, sorghum, wheat, or rice. The plant cell may also be of an algae, tree or vegetable. The modification introduced to the cell by the present invention may be such that the cell and progeny of the cell are altered for improved production of biologic products such as an antibody, starch, alcohol or other desired cellular output. The modification introduced to the cell by the present invention may be such that the cell and progeny of the cell include an alteration that changes the biologic product produced. In a preferred embodiment, the modification introduced to the cell by the present invention results in the cell and optionally the progeny of the cell including an alteration that changes the resistance of the cell to a plant pathogen. In a preferred embodiment the resistance is enhanced.

The system may comprise one or more different vectors. In an aspect of the invention, the effector protein is codon optimized for expression the desired cell type, preferentially a eukaryotic cell, preferably a plant.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A plant cell lines for tissue culture are known in the art and include, for example, suspension cell cultures prepared from several different plant species, including *Arabidopsis thaliana, Taxus cuspidata, Catharanthus roseus* and important domestic crops such as tobacco, alfalfa, rice, tomato and soybean. Tobacco suspension cells include in particularly those from the closely related cultivars BY-2 and NT-1. Cell lines are available from a variety of sources known to those with skill in the art (see, e.g., the Leibnitz Institute DSZM German Collection of Microorganisms and Cell Cultures). In some embodiments, a cell transfected with one or more vectors described herein is used to establish a new cell line comprising one or more vector-derived sequences. In some embodiments, a cell transiently transfected with the components of a RNA-targeting system as described herein (such as by transient transfection of one or more vectors, or transfection with RNA), and modified through the activity of a RNA-targeting complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments, one or more vectors described herein are used to produce a transgenic plant. In certain embodiments, the organism or subject or plant is algae. Methods for producing transgenic plants are known in the art, and generally begin with a method of cell transfection, such as described herein.

In one aspect, the invention provides for methods of modifying a target polynucleotide in a eukaryotic cell. In some embodiments, the method comprises allowing a RNA-targeting complex to bind to the target polynucleotide to effect cleavage of said target polynucleotide thereby modifying the target polynucleotide, wherein the RNA-targeting complex comprises a RNA-targeting effector protein complexed with a guide RNA hybridized to a target sequence within said target polynucleotide.

In one aspect, the invention provides a method of modifying expression of a polynucleotide in a eukaryotic cell. In some embodiments, the method comprises allowing a RNA-targeting complex to bind to the polynucleotide such that said binding results in increased or decreased expression of said polynucleotide; wherein the RNA-targeting complex comprises a RNA-targeting effector protein complexed with a guide RNA hybridized to a target sequence within said polynucleotide.

C2c2 Effector Protein Complexes can be Used in Plants

The C2c2 effector protein system(s) (e.g., single or multiplexed) can be used in conjunction with recent advances in crop genomics. The systems described herein can be used to perform efficient and cost effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The C2c2 effector protein system(s) can be used with regard to plants in Site-Directed Integration (SDI) or Gene Editing (GE) or any Near Reverse Breeding (NRB) or Reverse Breeding (RB) techniques. Aspects of utilizing the herein described C2c2 effector protein systems may be analogous to the use of the CRISPR-Cas (e.g. CRISPR-Cas9) system in plants, and mention is made of the University of Arizona website "CRISPR-PLANT" (http://www.genome.arizona.edu/crispr/) (supported by Penn State and AGI). Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR-Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR/Cas system," Cell Research (2013) 23:1229-1232. doi:10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at www.newphytologist.com); Caliando et al, "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061—*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," Nat Rev Genet. 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein.

Sugano et al. (Plant Cell Physiol. 2014 March; 55(3):475-81. doi: 10.1093/pcp/pcu014. Epub 2014 Jan. 18) reports the application of CRISPR-Cas9 to targeted mutagenesis in the liverwort *Marchantia polymorpha* L., which has emerged as a model species for studying land plant evolution. The U6 promoter of *M. polymorpha* was identified and cloned to express the gRNA. The target sequence of the gRNA was designed to disrupt the gene encoding auxin response factor 1 (ARF1) in *M. polymorpha*. Using *Agrobacterium*-mediated transformation, Sugano et al. isolated stable mutants in the gametophyte generation of *M. polymorpha*. CRISPR-Cas9-based site-directed mutagenesis in vivo was achieved using either the Cauliflower mosaic virus 35S or *M. polymorpha* EF1α promoter to express Cas9. Isolated mutant individuals showing an auxin-resistant phenotype were not chimeric. Moreover, stable mutants were produced by asexual reproduction of T1 plants. Multiple arf1 alleles were easily established using CRIPSR/Cas9-based targeted mutagenesis. The C2c2 systems of the present invention can be used to regulate the same as well as other genes, and like expression control systems such as RNAi and siRNA, the method of the invention can be inducible and reversible.

Kabadi et al. (Nucleic Acids Res. 2014 Oct. 29; 42(19): e147. doi: 10.1093/nar/gku749. Epub 2014 Aug. 13) developed a single lentiviral system to express a Cas9 variant, a reporter gene and up to four sgRNAs from independent RNA polymerase III promoters that are incorporated into the vector by a convenient Golden Gate cloning method. Each sgRNA was efficiently expressed and can mediate multiplex gene editing and sustained transcriptional activation in immortalized and primary human cells. The instant invention can be used to regulate the plant genes of Kabadi.

Xing et al. (BMC Plant Biology 2014, 14:327) developed a CRISPR-Cas9 binary vector set based on the pGreen or pCAMBIA backbone, as well as a gRNA. This toolkit requires no restriction enzymes besides BsaI to generate final constructs harboring maize-codon optimized Cas9 and one or more gRNAs with high efficiency in as little as one cloning step. The toolkit was validated using maize protoplasts, transgenic maize lines, and transgenic *Arabidopsis* lines and was shown to exhibit high efficiency and specificity. More importantly, using this toolkit, targeted mutations of three *Arabidopsis* genes were detected in transgenic seedlings of the T1 generation. Moreover, the multiple-gene mutations could be inherited by the next generation. (guide RNA)module vector set, as a toolkit for multiplex genome editing in plants. The C2c2 systems and proteins of the instant invention may be used to target the genes targeted by Xing.

The C2c2 CRISPR systems of the invention may be used in the detection of plant viruses. Gambino et al. (Phytopathology. 2006 November; 96(11):1223-9. doi: 10.1094/PHYTO-96-1223) relied on amplification and multiplex PCR for simultaneous detection of nine grapevine viruses. The C2c2 systems and proteins of the instant invention may similarly be used to detect multiple targets in a host. Moreover, the systems of the invention can be used to simultaneously knock down viral gene expression in valuable cultivars, and prevent activation or further infection by targeting expressed vial RNA.

Murray et al. (Proc Biol Sci. 2013 Jun. 26; 280(1765): 20130965. doi: 10.1098/rspb.2013.0965; published 2013 Aug. 22) analyzed 12 plant RNA viruses to investigate evolutionary rates and found evidence of episodic selection possibly due to shifts between different host genotypes or species. The C2c2 systems and proteins of the instant invention may be used to target or immunize against such viruses in a host. For example, the systems of the invention can be used to block viral RNA expression hence replication. Also, the invention can be used to target nucleic acids for cleavage as well as to target expression or activation. Moreover, the systems of the invention can be multiplexed so as to hit multiple targets or multiple isolate of the same virus.

Ma et al. (Mol Plant. 2015 Aug. 3; 8(8):1274-84. doi: 10.1016/j.molp.2015.04.007) reports robust CRISPR-Cas9 vector system, utilizing a plant codon optimized Cas9 gene, for convenient and high-efficiency multiplex genome editing in monocot and dicot plants. Ma et al. designed PCR-based procedures to rapidly generate multiple sgRNA expression cassettes, which can be assembled into the binary CRISPR-Cas9 vectors in one round of cloning by Golden Gate ligation or Gibson Assembly. With this system, Ma et al. edited 46 target sites in rice with an average 85.4% rate of mutation, mostly in biallelic and homozygous status. Ma et al. provide examples of loss-of-function gene mutations in T0 rice and T1 *Arabidopsis* plants by simultaneous targeting of multiple (up to eight) members of a gene family, multiple genes in a biosynthetic pathway, or multiple sites in a single gene. Similarly, the C2c2 systems of the instant invention can deficiency target expression of multiple genes simultaneously.

Lowder et al. (Plant Physiol. 2015 Aug. 21. pii: pp. 00636.2015) also developed a CRISPR-Cas9 toolbox enables multiplex genome editing and transcriptional regulation of expressed, silenced or non-coding genes in plants. This toolbox provides researchers with a protocol and reagents to quickly and efficiently assemble functional CRISPR-Cas9 T-DNA constructs for monocots and dicots using Golden Gate and Gateway cloning methods. It comes with a full suite of capabilities, including multiplexed gene editing and transcriptional activation or repression of plant endogenous genes. T-DNA based transformation technology is fundamental to modem plant biotechnology, genetics, molecular biology and physiology. As such, we developed a method for the assembly of Cas9 (WT, nickase or dCas9) and gRNA(s) into a T-DNA destination-vector of interest. The assembly method is based on both Golden Gate assembly and MultiSite Gateway recombination. Three modules are required for assembly. The first module is a Cas9 entry vector, which contains promoterless Cas9 or its derivative genes flanked by attL1 and attR5 sites. The second module is a gRNA entry vector which contains entry gRNA expression cassettes flanked by attL5 and attL2 sites. The third module includes attR1-attR2-containing destination T-DNA vectors that provide promoters of choice for Cas9 expression. The toolbox of Lowder et al. may be applied to the C2c2 effector protein system of the present invention.

Organisms such as yeast and microalgae are widely used for synthetic biology. Stovicek et al. (Metab. Eng. Comm., 2015; 2:13 describes genome editing of industrial yeast, for example, *Saccharomyces cerevisae*, to efficiently produce robust strains for industrial production. Stovicek used a CRISPR-Cas9 system codon-optimized for yeast to simultaneously disrupt both alleles of an endogenous gene and knock in a heterologous gene. Cas9 and gRNA were expressed from genomic or episomal 2p-based vector locations. The authors also showed that gene disruption efficiency could be improved by optimization of the levels of Cas9 and gRNA expression. Hlavovi et al. (Biotechnol. Adv. 2015) discusses development of species or strains of microalgae using techniques such as CRISPR to target nuclear and chloroplast genes for insertional mutagenesis and screening. The same plasmids and vectors can be applied to the C2c2 systems of the instant invention.

Petersen ("Towards precisely glycol engineered plants," Plant Biotech Denmark Annual meeting 2015, Copenhagen, Denmark) developed a method of using CRISPR/Cas9 to engineer genome changes in *Arabidopsis*, for example to glyco engineer *Arabidopsis* for production of proteins and products having desired posttranslational modifications. Hebelstrup et al. (Front Plant Sci. 2015 Apr. 23; 6:247) outlines in planta starch bioengineering, providing crops that express starch modifying enzymes and directly produce products that normally are made by industrial chemical and/or physical treatments of starches. The methods of Petersen and Hebelstrup may be applied to the C2c2 effector protein system of the present invention.

Kurthe t al, J Virol. 2012 June; 86(11):6002-9. doi: 10.128/JVI.00436-12. Epub 2012 Mar. 21) developed an RNA virus-based vector for the introduction of desired traits into grapevine without heritable modifications to the genome. The vector provided the ability to regulate expression of endogenous genes by virus-induced gene silencing. The C2c2 systems and proteins of the instant invention can be used to silence genes and proteins without heritable modification to the genome.

In an embodiment, the plant may be a legume. The present invention may utilize the herein disclosed CRISP-Cas system for exploring and modifying, for example, without limitation, soybeans, peas, and peanuts. Curtin et al. provides a toolbox for legume function genomics. (See Curtin et al., "A genome engineering toolbox for legume Functional genomics," International Plant and Animal Genome Conference XXII 2014). Curtin used the genetic transformation of CRISPR to knock-out/down single copy and duplicated legume genes both in hairy root and whole plant systems. Some of the target genes were chosen in order to explore and optimize the features of knock-out/down systems (e.g., phytoene desaturase), while others were identified by soybean homology to *Arabidopsis* Dicer-like genes or by genome-wide association studies of nodulation in *Medicago*. The C2c2 systems and proteins of the instant invention can be used to knockout/knockdown systems.

Peanut allergies and allergies to legumes generally are a real and serious health concern. The C2c2 effector protein system of the present invention can be used to identify and then edit or silence genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222).

In an advantageous embodiment, the plant may be a tree. The present invention may also utilize the herein disclosed CRISPR Cas system for herbaceous systems (see, e.g., Belhaj et al., Plant Methods 9: 39 and Harrison et al., Genes & Development 28: 1859-1872). In a particularly advantageous embodiment, the CRISPR Cas system of the present invention may target single nucleotide polymorphisms (SNPs) in trees (see, e.g., Zhou et al., New Phytologist, Volume 208, Issue 2, pages 298-301, October 2015). In the Zhou et al. study, the authors applied a CRISPR Cas system in the woody perennial *Populus* using the 4-coumarate:CoA ligase (4CL) gene family as a case study and achieved 100% mutational efficiency for two 4CL genes targeted, with every transformant examined carrying biallelic modifications. In the Zhou et al., study, the CRISPR-Cas9 system was highly sensitive to single nucleotide polymorphisms (SNPs), as cleavage for a third 4CL gene was abolished due to SNPs in the target sequence. These methods may be applied to the C2c2 effector protein system of the present invention.

The methods of Zhou et al. (New Phytologist, Volume 208, Issue 2, pages 298-301, October 2015) may be applied to the present invention as follows. Two 4CL genes, 4CL1 and 4CL2, associated with lignin and flavonoid biosynthesis, respectively are targeted for CRISPR-Cas9 editing. The *Populus tremula*×alba clone 717-1B4 routinely used for transformation is divergent from the genome-sequenced *Populus trichocarpa*. Therefore, the 4CL1 and 4CL2 gRNAs designed from the reference genome are interrogated with in-house 717 RNA-Seq data to ensure the absence of SNPs which could limit Cas efficiency. A third gRNA designed for 4CL5, a genome duplicate of 4CL1, is also included. The corresponding 717 sequence harbors one SNP in each allele near/within the PAM, both of which are expected to abolish targeting by the 4CL5-gRNA. All three gRNA target sites are located within the first exon. For 717 transformation, the gRNA is expressed from the *Medicago* U6.6 promoter, along with a human codon-optimized Cas under control of the CaMV 35S promoter in a binary vector. Transformation with the Cas-only vector can serve as a control. Randomly selected 4CL1 and 4CL2 lines are subjected to amplicon-sequencing. The data is then processed and biallelic mutations are confirmed in all cases. These methods may be applied to the C2c2 effector protein system of the present invention.

In plants, pathogens are often host-specific. For example, *Fusarium oxysporum* f. sp. *lycopersici* causes tomato wilt but attacks only tomato, and *F. oxysporum* F. *dianthii Puccinia graminis* f. sp. *tritici* attacks only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible. There can also be Horizontal Resistance, e.g., partial resistance against all races of a pathogen, typically controlled by many genes and Vertical Resistance, e.g., complete resistance to some races of a pathogen but not to other races, typically controlled by a few genes. In a Gene-for-Gene level, plants and pathogens evolve together, and the genetic changes in one balance changes in other. Accordingly, using Natural Variability, breeders combine most useful genes for Yield, Quality, Uniformity, Hardiness, Resistance. The sources of resistance genes include native or foreign Varieties, Heirloom Varieties, Wild Plant Relatives, and Induced Mutations, e.g., treating plant material with mutagenic agents. Using the present invention, plant breeders are provided with a new tool to induce mutations. Accordingly, one skilled in the art can analyze the genome of sources of resistance genes, and in Varieties having desired characteristics or traits employ the present invention to induce the rise of resistance genes, with more precision than previous mutagenic agents and hence accelerate and improve plant breeding programs.

Aside from the plants otherwise discussed herein and above, engineered plants modified by the effector protein and suitable guide, and progeny thereof, as provided. These may include disease or drought resistant crops, such as wheat, barley, rice, soybean or corn; plants modified to remove or reduce the ability to self-pollinate (but which can instead, optionally, hybridise instead); and allergenic foods such as peanuts and nuts where the immunogenic proteins have been disabled, destroyed or disrupted by targeting via a effector protein and suitable guide.

The system of the invention can be applied in areas of former RNA cutting technologies, without undue experimentation, from this disclosure, including therapeutic, assay and other applications, because the present application provides the foundation for informed engineering of the system. The present invention provides for therapeutic treatment of a disease caused by overexpression of RNA, toxic RNA and/or mutated RNA (such as, for example, splicing defects or truncations).

The innate immune system detects viral infection primarily by recognizing viral nucleic acids inside an infected cell, referred to as DNA or RNA sensing. In vitro RNA sensing assays can be used to detect specific RNA substrates. The RNA targeting effector protein can for instance be used for RNA-based sensing in living cells. Examples of applications are diagnostics by sensing of, for examples, disease-specific RNAs.

The RNA targeting effector protein of the invention can further be used for antiviral activity, in particular against RNA viruses. The effector protein can be targeted to the viral RNA using a suitable guide RNA selective for a selected viral RNA sequence. In particular, the effector protein may be an active nuclease that cleaves RNA, such as single stranded RNA. provided is therefore the use of an RNA targeting effector protein of the invention as an antiviral agent.

With respect to general information on CRISPR-Cas Systems, components thereof, and delivery of such components, including methods, materials, delivery vehicles, vectors, particles, and making and using thereof, including as to amounts and formulations, all useful in the practice of the instant invention, reference is made to: U.S. Pat. Nos. 8,999,641, 8,993,233, 8,945,839, 8,932,814, 8,906,616, 8,895,308, 8,889,418, 8,889,356, 8,871,445, 8,865,406, 8,795,965, 8,771,945 and 8,697,359; US Patent Publications US 2014-0310830 (U.S. application Ser. No. 14/105,031), US 2014-0287938 A1 (U.S. application Ser. No. 14/213, 991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105, 035), US 2014-0186958 (U.S. application Ser. No. 14/105, 017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patents EP 2 784 162 B1 and EP 2 771 468 Bi; European Patent Applications EP 2 771 468 (EP13818570.7), EP 2 764 103 (EP13824232.6), and EP 2 784 162 (EP14170383.5); and PCT Patent Publications PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO 2014/093701 (PCT/US2013/074800), WO 2014/018423 (PCT/US2013/051418), WO 2014/204723 (PCT/US2014/041790), WO 2014/204724 (PCT/US2014/041800), WO 2014/204725 (PCT/US2014/041803), WO 2014/204726 (PCT/US2014/041804), WO 2014/204727 (PCT/US2014/041806), WO 2014/204728 (PCT/US2014/041808), WO 2014/204729 (PCT/US2014/041809). Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent Applications Nos: PCT/US2014/041803, PCT/US2014/041800, PCT/US2014/041809, PCT/US2014/041804 and PCT/US2014/041806, each filed Jun. 10, 2014 6/10/14; PCT/US2014/041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013.

Mention is also made of U.S. application 62/091,455, filed, 12 Dec. 2014, PROTECTED GUIDE RNAS (PGRNAS); U.S. application 62/096,708, 24 Dec. 2014, PROTECTED GUIDE RNAS (PGRNAS); U.S. application 62/091,462, 12 Dec. 2014, DEAD GUIDES FOR CRISPR TRANSCRIPTION FACTORS; U.S. application 62/096,324, 23 Dec. 2014, DEAD GUIDES FOR CRISPR TRANSCRIPTION FACTORS; U.S. application 62/091,456, 12 Dec. 2014, ESCORTED AND FUNCTIONALIZED GUIDES FOR CRISPR-CAS SYSTEMS; U.S. application 62/091,461, 12 Dec. 2014, DELIVERY, USE AND THERAPEUTIC APPLICATIONS OF THE CRISPR-CAS SYSTEMS AND COMPOSITIONS FOR GENOME EDITING AS TO HEMATOPOETIC STEM CELLS (HSCs); U.S. application 62/094,903, 19 Dec. 2014, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 2014, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 2014, RNA-TARGETING SYSTEM; U.S. application 62/096,656, 24 Dec. 2014, CRISPR HAVING OR ASSOCIATED WITH DESTABILIZATION DOMAINS; U.S. application 62/096,697, 24 Dec. 2014, CRISPR HAVING OR ASSOCIATED WITH AAV; U.S. application 62/098,158, 30 Dec. 2014, ENGINEERED CRISPR COMPLEX INSERTIONAL TARGETING SYSTEMS; U.S. application 62/151,052, 22 Apr. 2015, CELLULAR TARGETING FOR EXTRACELLULAR EXOSOMAL REPORTING; U.S. application 62/054,490, 24 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 62/055,484, 25 Sep. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 2014, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 2014, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/054,675, 24 Sep. 2014, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 2014, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 2014, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 2014, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 2014, FUNCTIONAL SCREENING WITH OPTIMIZED FUNCTIONAL CRISPR-CAS SYSTEMS; U.S. application 62/055,487, 25 Sep. 2014, FUNCTIONAL SCREENING WITH OPTIMIZED FUNCTIONAL CRISPR-CAS SYSTEMS; U.S. application 62/087,546, 4 Dec. 2014, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 2014, CRISPR MEDIATED IN VIVO MODELING AND GENETIC SCREENING OF TUMOR GROWTH AND METASTASIS.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

Multiplex genome engineering using CRISPR/Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR/Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi: 10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013). [Epub ahead of print];

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure T M, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR/Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh O O, Barcena C, Hsu P D, Habib N, Gootenberg J S, Nishimasu H, Nureki O, Zhang F., Nature. January 29; 517(7536):583-8 (2015).

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR/Cas9 cleavage of viral DNA efficiently suppresses hepatitis B virus," Scientific Reports 5:10833. doi: 10.1038/srep10833 (Jun. 2, 2015)

Nishimasu et al., Crystal Structure of *Staphylococcus aureus* Cas9," Cell 162, 1113-1126 (Aug. 27, 2015)

Zetsche et al. (2015), "Cpf1 is a single RNA-guided endonuclease of a class 2 CRISPR-Cas system," Cell 163, 759-771 (Oct. 22, 2015) doi: 10.1016/j.cell.2015.09.038. Epub Sep. 25, 2015

Shmakov et al. (2015), "Discovery and Functional Characterization of Diverse Class 2 CRISPR-Cas Systems,"

Molecular Cell 60, 385-397 (Nov. 5, 2015) doi: 10.1016/j.molcel.2015.10.008. Epub Oct. 22, 2015

Gao et al, "Engineered Cpf1 Enzymes with Altered PAM Specificities," bioRxiv 091611; doi: http://dx.doi.org/10.1101/091611 (Dec. 4, 2016)

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR/Cas system for the one-step generation of mice carrying mutations in multiple genes which were traditionally generated in multiple steps by sequential recombination in embryonic stem cells and/or time-consuming intercrossing of mice with a single mutation. The CRISPR/Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays. Shalem et al. (2015) described ways in which catalytically inactive Cas9 (dCas9) fusions are used to synthetically repress (CRISPRi) or activate (CRISPRa) expression, showing, advances using Cas9 for genome-scale screens, including arrayed and pooled screens, knockout approaches that inactivate genomic loci and strategies that modulate transcriptional activity.

End Edits

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR/Cas9 knockout and nucleotide preference at the cleavage site. The authors also found that the sequence preference for CRISPRi/a is substantially different from that for CRISPR/Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS). Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Zetsche et al. (2015) reported the characterization of Cpf1, a putative class 2 CRISPR effector. It was demonstrated that Cpf1 mediates robust DNA interference with features distinct from Cas9. Identifying this mechanism of interference broadens our understanding of CRISPR-Cas systems and advances their genome editing applications.

Shmakov et al. (2015) reported the characterization of three distinct Class 2 CRISPR-Cas systems. The effectors of two of the identified systems, C2c1 and C2c3, contain RuvC like endonuclease domains distantly related to Cpf1. The third system, C2c2, contains an effector with two predicted HEPN RNase domains.

Gao et al. (2016) reported using a structure-guided saturation mutagenesis screen to increase the targeting range of Cpf1. AsCpf1 variants were engineered with the mutations S542R/K607R and S542R/K548V/N552R that can cleave target sites with TYCV/CCCC and TATV PAMs, respectively, with enhanced activities in vitro and in human cells.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

In addition, mention is made of PCT application PCT/US14/70057, filed on Dec. 12, 2014, entitled "DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS (claiming priority from one or more or all of US provisional patent applications: 62/054,490, filed Sep. 24, 2014; 62/010,441, filed Jun. 10, 2014; and 61/915,118, 61/915,215 and 61/915,148, each filed on Dec. 12, 2013) ("the Particle Delivery PCT"), incorporated herein by reference, with respect to a method of preparing an sgRNA-and-Cas9 protein containing particle comprising admixing a mixture comprising an sgRNA and Cas9 protein (and optionally HDR template) with a mixture comprising or consisting essentially of or consisting of surfactant, phospholipid, biodegradable polymer, lipoprotein and alcohol; and particles from such a process. For example, wherein Cas9 protein and sgRNA were mixed together at a suitable, e.g., 3:1 to 1:3 or 2:1 to 1:2 or 1:1 molar ratio, at a suitable temperature, e.g., 15-30C, e.g., 20-25C, e.g., room temperature, for a suitable time, e.g., 15-45, such as 30 minutes, advantageously in sterile, nuclease free buffer, e.g., 1×PBS. Separately, particle components such as or comprising: a surfactant, e.g., cationic lipid, e.g., 1,2-dioleoyl-3-trimethylammonium-propane (DOTAP); phospholipid, e.g., dimyristoylphosphatidylcholine (DMPC); biodegradable polymer, such as an ethylene-glycol polymer or PEG, and a lipoprotein, such as a low-density lipoprotein, e.g., cholesterol were dissolved in an alcohol, advantageously a $C_{1-6}$ alkyl alcohol, such as methanol, ethanol, isopropanol, e.g., 100% ethanol. The two solutions were mixed together to form particles containing the Cas9-sgRNA complexes. Accordingly, sgRNA may be pre-complexed with the Cas9 protein, before formulating the entire complex in a particle. Formulations may be made with a different molar ratio of different components known to promote delivery of nucleic acids into cells (e.g. 1,2-dioleoyl-3-trimethylammonium-propane (DOTAP), 1,2-ditetradecanoyl-sn-glycero-3-phosphocholine (DMPC), polyethylene glycol (PEG), and cholesterol) For example DOTAP: DMPC:PEG:Cholesterol Molar Ratios may be DOTAP 100, DMPC 0, PEG 0, Cholesterol 0; or DOTAP 90, DMPC 0, PEG 10, Cholesterol 0; or DOTAP 90, DMPC 0, PEG 5, Cholesterol 5. DOTAP 100, DMPC 0, PEG 0, Cholesterol 0. That application accordingly comprehends admixing sgRNA, Cas9 protein and components that form a particle; as well as particles from such admixing. Aspects of the instant invention can involve particles; for example, particles using a process analogous to that of the Particle Delivery PCT, e.g., by admixing a mixture comprising sgRNA and/or Cas9 as in the instant invention and components that form a particle, e.g., as in the Particle Delivery PCT, to form a particle and particles from such admixing (or, of course, other particles involving sgRNA and/or Cas9 as in the instant invention).

Previously, Zahir Ali, et al., Genome Biology, 2015, 16:238 reported efficacy of the CRISPR/Cas9 system for viral interference in plants, thereby extending the utility of this technology and opening the possibility of producing plants resistant to multiple viral infections.

In the examples of the present patent application it was unexpectedly found that it was possible to reduce the expression of two plant genes in plant cells significantly using a RNA targeting CRISPR system which uses a CRISPR effector protein which is RNA-guided. Notably, the two plant genes that were targeted, acting and polyubiquitin, are endogenously each strongly expressed in plants. This means that for the first time it was shown that it is possible that an RNA-targeting CRISPR system can be applied to plant cells. Moreover, the data present clear evidence that the CRISPR system represents an effective means capable of targeting RNA molecules even if they are strongly expressed. This opens up a multitude of different applications of RNA-targeting CRISPR system in plants. Thus, the applications described elsewhere in this patent application of the CRISPR system are fully applicable to plants and plant parts including plant cells.

Thus, in one aspect, the invention provides a plant comprising (a) a RNA-guided RNA-targeting Clustered Regularly Interspersed Short Palindromic Repeat (CRISPR) effector protein; and (b) a guide RNA (gRNA) which is in a complex with the CRISPR effector protein of (a); and wherein said guide RNA is capable of binding to a target RNA molecule from a pathogen that is capable of infecting said plant. Preferably, according to the invention, the plants contains several different gRNA molecules (for example at least two or three), wherein the gRNAs bind to the same or to different target RNAs.

In the following, the utility and possible uses of this CRISPR system in plants is outlined. All of these uses are according to the invention and can be combined if applicable with other applications disclosed elsewhere in this application. The following uses are further not intended to be limiting or exclusive. The merely represent exemplary embodiments.

For example, the CRISPR system can be used to manufacture plants which are engineered and not naturally occurring which comprise such a CRISPR system and which makes these plants immune against viral and/or fungal pathogens.

For DNA viruses, the RNA-guided RNA-targeting CRISPR effector protein can be delivered post-infection of the plant or plant cell transiently into this plant or plant cell to reduce virulence and pathogenicity of the virus. Alternatively the CRISPR system can also be introduced into the plant to act prophylactically. This can be achieved by repeated transient delivery, or by stably integrating the necessary components of the CRISPR system into the genome of the plant or plant cell. For RNA viruses, similar approaches can be used. In any case, preferably a class 2, type VI effector protein, more preferably a C2c2 effector protein is used.

The above approaches can, for example, be used against beet sever curly top virus (DNA virus), for example, by targeting the RNA of the C4 protein of this virus (see also Kunling Teng, et al., PLoS One, 2010; 5(6): e11280). The CRISPR system according to the invention is further suitable in methods for production of plants which are resistant to Bean yellow dwarf virus (BeYDV), Tomato yellow leaf curl virus (DNA), *Merremia* mosaic virus (DNA), Tobacco mosaic virus (RNA), Tomato spotted wilt virus (RNA), Tomato yellow leaf curl virus (DNA), Cucumber mosaic virus (RNA), Potato virus Y (RNA), Cauliflower mosaic virus (DNA virion, RNA intermediate), African cassava mosaic virus (DNA), Plum pox virus (RNA), Brome mosaic virus (RNA), Potato virus X (RNA) and other viruses.

The plant CRISPR system according to the invention is also effective against fungal infection and other pests. For example, a plant can be produced which is resistant against powdery mildew infection and Blight resistance in potatoes can be conveyed, as described herein above. Rice Blast is the most devastating disease causing major yield losses in every year worldwide. It had been proved that using resistant rice varieties would be the most effective way to control this disease. The CRISPR system according to the invention can also be used to make rice plants or rice plant cells resistant against Blast. This could be done by using a gRNA which is specific for OsERF922 (see also Fujun Wang, et al, PLOS ONE, DOI:10.1371/journal.pone.0154027 Apr. 26, 2016, "Enhanced Rice Blast Resistance by CRISPR/Cas9-Targeted Mutagenesis of the ERF Transcription Factor Gene OsERF922").

The CRISPR system, according to the invention, can further be used in a method using the CRISPR system in plant protoplasts for screening for additional resistance genes in plants. It can be further used for metabolic engineering in plants, e.g. modulating the amount of mRNA in a plant cell.

The CRISPR system according to the invention, which preferably uses a C2c2 effector protein, can further be used to either knockdown or upregulate expression by modifying translation efficiency. The CRISPR system according to the invention can also be used to engineer a plant for synthesizing drugs or antibodies (see e.g. Chen Q, et al., Hum Vaccin. 2011 March; 7(3):331-8. Epub 2011 Mar. 1, or Jian Yao et al., Int. J. Mol. Sci. 2015, 16, 28549-28565). Such engineered plants or plant parts can be used for the chemical synthesis of small molecules (Natalia Dudareva et al., New Phytologist, Volume 198, Issue 1, April 2013, pages 16-32), to increase chlorophyll B production or reducing it (preferably by regulating CAO1, see Jin Miao, et al., Cell Research (2013) 23:1233-1236. doi:10.1038/cr.2013.123; published online 3 Sep. 2013) or can be used to reduce amylose synthesis in plants (e.g. by targeting osWaxy; see Xingliang Ma, et al., Molecular Plant, Volume 8, Issue 8, p1274-1284, 3 Aug. 2015).

The RNA-guided RNA-targeting Clustered Regularly Interspersed Short Palindromic Repeat (CRISPR) effector protein in plants can also be used to promote herbicide resistance, to increasing ALS to promote branched chain amino acid synthesis (Masaki Endo et al., Plant Physiology February 2016 vol. 170 no. 2 667-677), to reduce the toxicity of allyl alcohol (e.g. via knockdown of ADH1 as described by Terry R. Conley et al., in Plant Physiol. 1999 February; 119(2): 599-608) to remove or knock-down polyphenol oxidase in plants or plant parts (see e.g. Daniel Ferreira Holderbaum et al., HortScience August 2010 vol. 45 no. 8 1150-1154) and to improve carbon fixation in plants (see e.g. Thomas Schwander et al., Science 18 Nov. 2016: Vol. 354, Issue 6314, pp. 900-904).

As shown above, the present invention can be applied to solve a variety of problems and to produce new plants which have superior traits compared to non-modified plants.

The components (polynucleotide(s) encoding the CRISPR effector protein and gRNA) can be introduced into the plants or part of plants by using methodology which is known in the art and described herein above. For example, particle bombardment can be used. Alternatively, biological vectors can be used such as the bacterial delivery using e.g. *agrobacterium* or a viral delivery system (e.g. Geminivirus—see also Edward M Golenberg et al., Plant Methods 2009, 5:9 and Chen Q et al., Hum Vaccin. 2011 March; 7(3):331-8. Epub 2011 Mar. 1). Alternatively or additionally, also, protoplast transfection can be used to deliver the CRISPR system of the invention into plant cells. Also, a chloroplast delivery can be employed using a plastid expression vector as described for example by Shabir H. Wani et al., Curr Genomics. 2010 November; 11(7): 500-512.

As plants are a source of food, the CRISPR effector protein according to the invention can be used, together with a suitable gRNA for food engineering (including for obtaining nutrition/taste improvements). Further, the system can be used to make temperature sensitive hybrid rice by reducing the RNase ZS1 function in the plants (see e.g. Hai Zhou, et al., Nature Communications 5, Article number: 4884, 2014) or to improve the abiotic stress responses in plants (see e.g. Yuriko Osakabe, et al., Scientific Reports 6, Article number: 26685). Selectively down- or upregulating gene expression using the CRISPR system of the invention in plants can also be used to identify other genes or proteins which respond based on gene expression and to find heterozygosity robustness genes.

The uses described herein have become accessible by the finding that RNA-guided RNA-targeting Clustered Regularly Interspersed Short Palindromic Repeat (CRISPR) effector proteins can function in plants.

Accordingly, one aspect of the invention relates to a plant comprising a first component which is (a1) a CRISPR effector protein, or (a2) a polynucleotide encoding the CRISPR effector protein of (a1); and/or a second component which is (b1) a guide RNA (gRNA) comprising a guide sequence, or (b2) a polynucleotide encoding the gRNA of (b1), wherein the gRNA is capable of forming a complex with the CRISPR effector protein in said plant, and wherein the gRNA in said complex is capable of binding to a target RNA molecule. Preferably, the plant expresses or is capable of expressing the first and/or the second component. The expression may be tissue-specific and/or inducible as described further herein. In a preferred embodiment, expression of the first and/or the second component is induced upon or by infection by a specific plant pathogen. In such an embodiment, the expression of the first and/or the second component may be regulated by an endogenous plant pathogen defense promotor, e.g. the promotor of a resistance gene as described further herein. Preferably, the plant pathogen inducing the expression of the first and/or the second component is targeted by the CRISPR system, i.e. the plant pathogen comprises or encodes the target RNA. As a result of expressing the CRISPR system, the plant may exhibit a new or altered trait, such as, for example, increased expression of a biological product and/or resistance to a plant pathogen.

A plant expressing the RNA-guided RNA-targeting Clustered Regularly Interspersed Short Palindromic Repeat (CRISPR) effector protein can be used for crossings with plants that express one or more different gRNAs.

Thus, a further aspect of the invention relates to a plant comprising (a) a Clustered Regularly Interspersed Short Palindromic Repeat (CRISPR) effector protein; and (b) a guide RNA (gRNA) which is in a complex with the CRISPR effector protein of (a); and wherein said guide RNA is capable of binding to a target RNA molecule from a pathogen that is capable of infecting said plant. The plant may also comprise the polynucleotides of (a2) and/or (b2) as described herein.

In a further aspect, the invention provides a plant comprising (a2) a polynucleotide that expresses a Clustered Regularly Interspersed Short Palindromic Repeat (CRISPR) effector protein in one or more cells of said plant; wherein said CRISPR effector protein is a RNA-guided RNase; and said polynucleotide is codon optimized for expression in said one or more plant cells. Codon optimization in plants can be done using methods known in the art. Plant codon usage is known for example from E Murray et al., Nucleic Acids Res. 1989 Jan. 25; 17(2): 477-498. Further guidance is found also in the article by S. Kumar et al., "Plant codon optimized cry genes of *Bacillus thuringiensis* can be expressed as soluble proteins in *Escherichia coli* BL21 Codon Plus strain as NusA-Cry protein fusions", Journal of Invertebrate Pathology, Volume 88, Issue 1, January 2005, Pages 83-86. It will be appreciated that also in other aspects of the invention it is preferred that the polynucleotide(s) encoding the CRISPR effector protein and/or comprising or encoding the gRNA(s) is/are codon optimized for expression in the plant cell or plant of the invention.

As outlined throughout this specification the use of RNA-guided RNA-targeting Clustered Regularly Interspersed Short Palindromic Repeat (CRISPR) effector protein in plants or plant parts opens the door to multiple applications. Thus, in a preferred embodiment of the above described aspects of the invention, said complex in the plant is, upon binding to the target RNA molecule, capable of (i) cleaving said target RNA molecule; (ii) increasing the translation of said target RNA molecule; (iii) reducing the translation of said target RNA molecule or (iv) modulating the splicing of said target RNA molecule.

In further preferred embodiments, the binding of the guide RNA (gRNA) in the CRISPR effector protein to the target RNA molecule is selective such that said gRNA binds with higher affinity to said target RNA molecule than to any RNA molecule from said plant. The degree of binding affinity can be tested by multiple methods known to the average skilled person and preferably by hybridization as also described herein. In a more preferred embodiment, the guide RNA in a plant cell essentially does not bind to any of the plant RNA molecules. The "plant RNA molecules" preferably include only those RNA molecules which are present in the plant cell prior to the infection by a pathogen.

In embodiments where said guide RNA is capable of binding to a target RNA molecule from a pathogen that is capable of infecting said plant, it is preferred that said target RNA molecule is part of said pathogen or transcribed from a DNA molecule of said pathogen. Thus, the target RNA is preferably not endogenously expressed in said plant.

It is further preferred that said CRISPR effector protein cleaves said target RNA molecule of said pathogen in said plant if said pathogen infects or has infected said plant. In other words, the CRISPR effector protein is preferable capable of catalyzing the hydrolisation of a bond in the target RNA molecule.

It is preferred that said CRISPR effector protein in a plant, according to the invention, is a Type VI CRISPR effector protein, more preferably a C2c2 effector protein.

It was shown in the examples provided in this specification that some CRISPR effector proteins function particularly well in plants, such as a C2c2 effector protein obtained from Listeriaceae bacteria. When blasting this C2c2 effector protein against non-redundant protein databases, several closely related C2c2 effector orthologs in other bacteria were found. According to these findings, plants according to the invention are particularly preferred where the CRISPR effector protein is derived from a bacterium belonging to (i) the phylum Firmicutes and preferably from the class Bacilli of said phylum, and most preferably from a Listeriaceae or Coriobacteriaceae bacterium or (ii) the phylum Bacteroidetes and preferably from the class Bacteroidia of said phylum, and most preferably from a *Paludibacter* bacterium.

More preferably, the C2c2 effector protein is from a Listeriaceae bacterium and most preferably from Listeriaceae bacterium FSL M6-0635.

In preferred embodiments of the plants of the invention, the plant is selected from the group consisting of *Oryza sativa, Solanum tuberosum, Solanum lycopersicum, Zea mays, Triticum* spp., *Triticum aestivum, Sorghum bicolor, Dioscorea* spp., *Musa* spp., *Manihot esculenta, Glycine max, Gossypium hirsutum, Hordeum vulgare, Avena sativa, Secale cereale, Brassica rapa* and *Brassica napus*.

The technology of the invention will be particularly valuable in plants which are economically of high interest. Accordingly, the plant according to the invention is preferably a cereal plant, a pseudocereal plant or a vegetable plant.

The following table specifies several particularly preferred plants of the invention where the CRISPR effector protein in said plant, according to the invention, is a C2c2 effector protein from the indicated bacterial origin and wherein the plant is a plant as further specified in the table:

| Bacterium from which the C2c2 effector protein is obtained: | Plant |
|---|---|
| Bacterium belonging to the phylum Firmicutes and the class *Bacilli* | cereal plant, a pseudocereal plant or a vegetable plant |
| Bacterium belonging to the phylum Bacteroidetes and from the class *Bacteroidia* | cereal plant, a pseudocereal plant or a vegetable plant |
| *Listeriaceae* bacterium | cereal plant, a pseudocereal plant or a vegetable plant |
| *Carnobacteriaceae* bacterium | cereal plant, a pseudocereal plant or a vegetable plant |
| *Paludibacter* bacterium | cereal plant, a pseudocereal plant or a vegetable plant |
| *Listeriaceae* bacterium FSL M6-0635 | cereal plant, a pseudocereal plant or a vegetable plant |
| Bacterium belonging to the phylum Firmicutes and the class *Bacilli* | A monocot plant |
| Bacterium belonging to the phylum Bacteroidetes and from the class *Bacteroidia* | A monocot plant |
| *Listeriaceae* bacterium | A monocot plant |
| *Carnobacteriaceae* bacterium | A monocot plant |
| *Paludibacter* bacterium | A monocot plant |
| *Listeriaceae* bacterium FSL M6-0635 | A monocot plant |

Most preferably, the plant of the invention is a rice plant.

In further preferred embodiments of the plants of the invention, the C2c2 effector protein has an amino acid sequence identity of at least 90%, 91%, 92%, 93%, 94%, 95%, 96%, 97%, 98%, 99% or 100% to SEQ ID NO: 11 over the entire length of SEQ ID NO: 11. In this context it is to be understood that a sequence identity below 100% does not abolish the function of the C2c2 effector protein. Therefore, such C2c2 effector protein with a sequence identity below 100% as described above preferably has RNase activity when in complex with said gRNA and said target RNA.

In a plant of the invention, the polynucleotide (a2) and/or the polynucleotide (b2) is preferably stably integrated into the genome of the plant. The plant of the invention is preferably a transgenic plant.

A further aspect of the invention relates to a part of the plant of the invention, i.e. to a plant part. Preferably, said part is selected from the group consisting of a plant cell, a somatic embryo, a pollen, a gametophyte, an ovule, a leaf, a seedling, a stem, a callus, a stolon, a microtuber, a shoot, a seed, a fruit and a spore. The plant cell may also be a protoplast.

A further aspect of the invention relates to a composition comprising at least two, at least five, at least ten, at least fifty, at least one hundred or at least one thousand plant parts of the invention. Preferably, the composition may comprise at least 2, at least 5, at least 10, at least 50, at least 100 or at least 1000 seeds, fruits or spores.

In a further aspect, the invention also relates to a processed product obtained from the plant or plant part of the invention. Such a processed product may be obtained by subjecting the plant or plant part of the invention to one or more processing steps, which may, for example, include washing, peeling, cutting, seasoning, concentrating, pressing, drying, dehyrdating, freezing, heating, preserving, e.g. by pasteurizing, pickling, salting or the like, and/or packaging of the plant or plant part of the invention, e.g. canning, or combining it with additional ingredients such as additional salt, sugar or fat. Preferably, the processed product is a foodstuff.

In a further aspect the invention provides a packaging comprising the plant of the invention, the plant part of the invention or the composition of the invention. A packaging according to the invention is preferably a packaging selected from the group consisting of a bag, a box, a carton, a case, a tray, a can, a roll and a wrapping.

The invention further provides also a composition comprising a plant part of the invention and ethylene.

The invention also provides in yet a further aspect an engineered or non-naturally occurring Clustered Regularly Interspersed Short Palindromic Repeat (CRISPR) system comprising a first component which is (a1) a CRISPR effector protein, or (a2) a polynucleotide encoding the CRISPR effector protein of (a1); and a second component which is (b1) a guide RNA (gRNA) comprising a guide sequence, or (b2) a polynucleotide encoding the gRNA of (b1), wherein the gRNA is capable of forming a complex with the CRISPR effector protein in a plant, and wherein the gRNA in said complex is capable of binding to a target RNA molecule.

Also provided is, in a further aspect of the invention a polynucleotide comprising the polynucleotides of (a2) and (b2) as defined in herein. Such polynucleotides can be used to produce a plant according to the invention.

A further aspect of the invention relates to a vector comprising the polynucleotide of the invention. Preferably, the vector is a plant viral vector. In a preferred embodiment, the vector comprises a regulatory element. A regulatory element may, for example be a promotor. A promotor is preferably selected from the group consisting of a plant actin promoter, a plant U6 promoter and a CaMV 35 S promoter which drives the transcription of (a2) and/or (b2). In a more preferred embodiment, the polynucleotide encoding the CRISPR effector protein is under the control of a rice actin promoter if the vector is to be used in a monocot plant and under the control of a 35S promoter if the vector is to be used in a dicot plant. Further, it is preferred that the gRNA is under the control of a U6 promotor. Preferably, in monocots a rice U6 promoter and in dicots an *arabidopsis* U6 promoter is used.

Furthermore the invention provides in a further aspect a vector system comprising a first vector comprising the polynucleotide of (a2) as defined herein and a second vector comprising the polynucleotide of (b2) as defined herein. Preferably, the first and/or second vector is a plant viral vector.

Also provided is a delivery system of the invention that comprises the system of the invention, the polynucleotide of the invention, the vector of the invention or the vector system of the invention. A preferred delivery system is a particle, a nanoparticle or *Agrobacterium tumefaciens*.

A further aspect of the invention is a method for producing a plant cell wherein the amount of a target RNA or translation of a target RNA is modified (i.e. increased or decreased with respect to the amount of target RNA in another plant cell that does not comprise said system, polynucleotide, vector and vector system), comprising delivering the system of the invention, the polynucleotide of the invention, the vector of the invention or the vector system of the invention into said plant cell.

Also provided is a method for producing a plant according to the invention wherein the amount of a target RNA or translation of a target RNA is modified comprising
(a) producing a plant cell according to the method of the invention and regenerating a plant from said plant cell; or (b) delivering the system of the invention, the polynucleotide of the invention, the vector of the invention or the vector system of the invention into one or more cells of the plant.

A further aspect of the invention relates to the use of the (non-naturally occurring or engineered) system of the invention, the polynucleotide of the invention, the vector of the invention, the vector system of the invention or the delivery system of the invention for producing a plant cell, a plant cell line, a plant part or a plant wherein the amount of a target RNA or translation of a target RNA is modified (compared to a control plant cell, a plant cell line, a plant part or a plant which does not comprise said system of the invention, the polynucleotide of the invention, the vector of the invention, the vector system of the invention or the delivery system of the invention).

The invention also provides the use of a CRISPR system according to the invention which is an RNA-guided RNase for inducing cell death in a plant cell infected with a plant pathogen.

In addition, the invention relates to the use of the (non-naturally occurring or engineered) system of the invention, the polynucleotide of the invention, the vector of the invention, the vector system or the delivery system of the invention for treating, preventing or ameliorating plant disease in a plant. The invention also relates to a method for treating, preventing or ameliorating plant disease in a plant comprising delivering the (non-naturally occurring or engineered) system of the invention, the polynucleotide of the invention, the vector of the invention and/or the vector system of the invention to the plant. Delivery may occur prior or subsequent to the invention, i.e. the use may be a prophylactic or a therapeutic use. Further, the invention relates to the use of the (non-naturally occurring or engineered) system of the invention, the polynucleotide of the invention, the vector of the invention, the vector system or the delivery system of the invention for inducing, promoting, or improving plant resistance to a plant pathogen. Furthermore, the invention relates to a method of inducing, promoting, or improving plant resistance to a plant pathogen comprising delivering the (non-naturally occurring or engineered) system of the invention, the polynucleotide of the invention, the vector of the invention and/or the vector system of the invention to the plant.

In particular embodiments, the invention relates to methods for treating, preventing or ameliorating a plant disease in a plant comprising delivering a guide RNA (gRNA) comprising a guide sequence to said plant, wherein said guide sequence is directed to a target RNA which is causative of said disease. In these embodiments, said plant comprises a CRISPR effector protein and the gRNA is capable of forming a complex with the CRISPR effector protein in said plant. More particularly the plant may be capable of expressing the CRISPR effector protein in one or more tissues of the plant. In particular embodiments, the expression of the CRISPR effector protein is under control of an inducible promoter. For instance, in particular embodiments expression of the CRISPR effector protein can be induced by contacting the plant with an agent which induces expression of said CRISPR effector protein. In particular embodiments, the guide RNA is administered to the plant, such as by spraying it on the plant or relevant plant part.

In particular embodiments, the plant disease is caused by a plant pathogen. In these embodiments, the guide RNA may be directed at a target RNA in said plant pathogen.

In particular embodiments, the CRISPR effector protein and the guide RNA or one or more nucleotide sequences encoding said CRISPR effector protein and said guide RNA are administered to said plant. More particularly, the CRISPR effector protein can be administered as a protein or as a nucleotide sequence encoding said protein. In particular embodiments, the CRISPR effector protein and/or the guide RNA are administered to the plant in the form of a microorganism expressing and secreting the CRISPR effector protein and/or the guide RNA.

The invention further relates to plant protection compositions comprising one or more of the components described herein. More particularly, the plant protection product comprises a guide RNA or a sequence encoding said guide RNA, wherein the guide RNA comprises a guide sequence directed at a target RNA which is causative of a plant disease. In particular embodiments, the target RNA is RNA of a plant pathogen. In particular embodiments, the plant protection composition comprises one or more guide RNAs directed against one or more plant pathogens. In particular embodiments, the plant protection composition is a sprayable composition. In particular embodiments, the plant protection composition comprises a micro-organism which is capable of expressing and secreting the CRISPR effector protein and/or one or more guide RNAs.

Further, the invention also relates to a method of inducing cell death in a plant cell infected with a plant pathogen comprising the steps of delivering a CRISPR system of the invention into said plant. Delivery may occur prior or subsequent to the infection.

The invention further provides a method for identifying a CRISPR system which is functional in a plant cell comprising the steps (a) expressing a CRISPR effector protein candidate in the plant cell; (b) providing a gRNA to form a complex with the CRISPR effector protein candidate in (a) in said plant cell; (c) quantifying target RNA in the plant cell, where said target RNA is an RNA to which the gRNA in said complex can bind in the plant cell; and (d) selecting said candidate if the quantity determined in c) is reduced as compared to a plant cell having no CRISPR effector protein and/or no gRNA.

In a further aspect the invention provides a method for targeted breeding of plants (a) expressing a CRISPR effector protein in a plurality of plant cells; (b) providing a gRNA to form a complex with the CRISPR effector protein in said plant cells; (c) quantifying target RNA in the plant cells, where said target RNA is an RNA to which the gRNA in said complex can bind in the plant cells; and (d) selecting a plant cell if the quantity determined in c) is reduced as compared to a plant cell or plant having no CRISPR effector protein and/or no gRNA. In a preferred embodiment, the method comprises the further step(s) (e) of regenerating the plant cell selected in (d) into a plurality of plants and optionally (f) of using the plants regenerated in step (e) in breeding. In a further aspect the invention provides a method for targeted breeding of plants (a) expressing a CRISPR effector protein in a plurality of plant cells; (b) providing a gRNA to form a complex with the CRISPR effector protein in said plant cells; (c) regenerating the plant cells into a plurality of plants; (d) assessing a phenotype associated with a target RNA to which the gRNA in said complex can bind in the plant cells; and (e) selecting a plant having alternation to said phenotype compared to a plant having no CRISPR effector protein and/or no gRNA. In a preferred embodiment, the method further comprises a step (f) of using the plant selected in (e) in breeding further plants.

In a plant of the invention, in a plant part of the invention, in a composition of the invention, in a packaging of the invention and in the uses according to the invention it is preferred that the CRISPR effector protein is a C2c2 effector protein selected from the group comprising *Leptotrichia shahii* C2c2, *Leptotrichia wadei* F0279 (Lw2) C2c2, *Listeria seeligeri* C2c2, Lachnospiraceae bacterium MA2020 C2c2, Lachnospiraceae bacterium NK4A179 C2c2, *Clostridium aminophilum* DSM 10710 C2c2, *Carnobacterium gallinarum* DSM 4847 C2c2, *Carnobacterium gallinarum* DSM 4847 C2c2, *Paludibacter propionicigenes* WB4 C2c2, *Listeria weihenstephanensis* FSL R9-0317 C2c2, Listeriaceae bacterium FSL M6-0635 C2c2, *Leptotrichia wadei* F0279 C2c2, *Rhodobacter capsulatus* SB 1003 C2c2, *Rhodobacter capsulatus* R121 C2c2, *Rhodobacter capsulatus* DE442 C2c2, *Leptotrichia buccalis* C-1013-b C2c2, *Herbinix hemicellulosilytica* C2c2, *Eubacterium rectale* C2c2, Eubacteriaceae bacterium CHKCI004 C2c2, *Blautia* sp. Marseille-P2398 C2c2, *Leptotrichia* sp. oral taxon 879 str. F0557 C2c2, Lachnospiraceae bacterium NK4A144 C2c2, RNA-binding protein S1 *Chloroflexus aggregans* C2c2, *Demequina aurantiaca* C2c2, *Thalassospira* sp. TSL5-1 C2c2, SAMN04487830_13920 *Pseudobutyrivibrio* sp. OR37 C2c2, SAMN02910398_00008 *Butyrivibrio* sp. YAB3001 C2c2, *Blautia* sp. Marseille-P2398 C2c2, *Leptotrichia* sp. Marseille-P3007 C2c2, *Bacteroides ihuae* C2c2, SAMN05216357_1045 Porphyromonadaceae bacterium KH3CP3RA C2c2, *Listeria riparia* C2c2, *Insolitispirillum peregrinum* C2c2, or a effector protein which comprises RNase activity when in complex with said gRNA and said target RNA, and wherein said effector protein has an amino acid sequence identity to any of SEQ ID NO: 1 to 15 or 50 to 67 of at least 90%.

In a plant of the invention, in a plant part of the invention, in a composition of the invention, in a packaging of the invention and in the uses according to the invention it is preferred that the pathogen is selected from the group consisting of Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), *Citrus tristeza* virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis* mosaic virus (ArMV), or *Rupestris* stem pitting-associated virus (RSPaV).

In preferred embodiments of all aspects and embodiments according to the invention, the CRISPR system comprises more than one gRNA, wherein the gRNAs bind to the same or to different target RNAs.

Yet a further aspect of the invention relates to a method for improving a CRISPR system in a plant comprising the steps (a) expressing a CRISPR effector protein in a plant cell; (b) providing a gRNA to form a complex with the CRISPR effector protein of (a) in said plant cell; (c) quantifying target RNA in the plant cell, where said target RNA is an RNA to which the gRNA in said complex can bind in the plant cell; and (d) comparing the quantified target RNA in (c) with the target RNA quantified in another plant cell that comprises the target RNA, the CRISPR effector protein and the gRNA, except that either the CRISPR effector protein or the gRNA has been modified compared to the versions used in step (a) and (b); and (e) determining whether the modification in (d) results in a different target RNA amount in said cell.

In certain embodiments, the C2c2 protein according to the invention is or is derived from one of the orthologues as described in the table below, or is a chimeric protein of two or more of the orthologues as described in the table below, or is a mutant or variant of one of the orthologues as described in the table below (or a chimeric mutant or variant), including dead C2c2, split C2c2, destabilized C2c2, etc. as defined herein elsewhere, with or without fusion with a heterologous/functional domain.

TABLE 1

C2c2 orthologues

| C2c2 orthologue | Code | Multi Letter |
|---|---|---|
| *Leptotrichia shahii* | C2-2 | Lsh |
| *L wadei* F0279 (Lw2) | C2-3 | Lw2 |
| *Listeria seeligeri* | C2-4 | Lse |
| *Lachnospiraceae* bacterium MA2020 | C2-5 | LbM |
| *Lachnospiraceae* bacterium NK4A179 | C2-6 | LbNK179 |
| [*Clostridium*] *aminophilum* DSM 10710 | C2-7 | Ca |
| *Carno*bacterium*gallinarum* DSM 4847 | C2-8 | Cg |
| *Carno*bacterium*gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| *Listeriaceae* bacterium FSL M6-0635 | C2-12 | LbFSL |
| *Leptotrichia wadei* F0279 | C2-13 | Lw |
| *Rhodobacter capsulatus* SB 1003 | C2-14 | Rc |
| *Rhodobacter capsulatus* R121 | C2-15 | Rc |
| *Rhodobacter capsulatus* DE442 | C2-16 | Rc |
| *Leptotrichia buccalis* C-1013-b | C2-17 | Lbu |
| *Herbinix hemicellulosilytica* | C2-18 | Hhe |
| [*Eu*bacterium] *rectale* | C2-19 | Ere |
| *Eubacteriaceae* bacterium | C2-20 | Eba |
| *Blautia* sp. *Marseille*-P2398 | C2-21 | BSm |

TABLE 1-continued

C2c2 orthologues

| C2c2 orthologue | Code | Multi Letter |
|---|---|---|
| *Leptotrichia* sp. oral taxon 879 str. F0557 | C2-22 | Lsp |
| *Lachnospiraceae* bacterium NK4A144 | C2-23 | NK4A144 |
| RNA-binding protein S1 *Chloroflexus aggregans* | C2-24 | |
| *Demequina aurantiaca* | C2-25 | |
| *Thalassospira* sp. TSL5-1 | C2-26 | |
| SAMN04487830_13920 *Pseudobutyrivibrio* sp. OR37 | C2-27 | |
| SAMN02910398_00008 *Butyrivibrio* sp. | C2-28 | |
| *Blautia* sp. *Marseille*-P2398 | C2-29 | |
| *Leptotrichia* sp *Marseille*-P3007 | C2-30 | |
| *Bacteroides ihuae* | C2-31 | |
| SAMN05216357_1045 *Porphyromonadaceae* bacterium KH3CP3RA | C2-33 | |
| *Listeria riparia* | C2-33 | |
| *Insolitispirillum peregrinum* | C2-34 | |

The wild type protein sequences of the above species are listed in the Table below. In certain embodiments, a nucleic acid sequence encoding the C2c2 protein is provided.

TABLE 2 amino acid sequences of C2c2 orthologoues

| Code | SEQ ID NO | Bacterial strain |
|---|---|---|
| C2c2-2 | 1 | *L shahii* (Lsh) |
| c2c2-3 | 2 | *L wadei* (Lw2) |
| c2c2-4 | 3 | *Listeria seeligeri* |
| c2c2-5 | 4 | *Lachnospiraceae* bacterium MA2020 |
| c2c2-6 | 5 | *Lachnospiraceae* bacterium NK4A179 |
| c2c2-7 | 6 | [*Clostridium*] *aminophilum* DSM 10710 |
| c2c2-8 | 7 | *Carno*bacterium*gallinarum* DSM 4847 |
| c2c2-9 | 8 | *Carno*bacterium*gallinarum* DSM 4847 |
| c2c2-10 | 9 | *Paludibacter propionicigenes* WB4 |
| c2c2-11 | 10 | *Listeria weihenstephanensis* FSL R9-0317 |
| c2c2-12 | 11 | *Listeriaceae* bacterium FSL M6-0635 = *Listeria newyorkensis* FSL M6-0635 |
| c2c2-13 | 12 | *Leptotrichia wadei* F0279 |
| c2c2-14 | 13 | *Rhodobacter capsulatus* SB 1003 |
| c2c2-15 | 14 | *Rhodobacter capsulatus* R121 |
| c2c2-16 | 15 | *Rhodobacter capsulatus* DE442 |
| C2-17 | 53 | *Leptotrichia buccalis* C-1013-b |
| C2-18 | 54 | *Herbinix hemicellulosilytica* |
| C2-19 | 55 | [*Eubacterium*] *rectale* |
| C2-20 | 56 | *Eubacteriaceae* bacterium CHKCI004 |
| C2-21 | 57 | *Blautia* sp. *Marseille*-P2398 |
| C2-22 | 58 | *Leptotrichia* sp. oral taxon 879 str. F0557 |
| C2-23 | 59 | *Lachnospiraceae* bacterium NK4A144 |
| C2-24 | 60 | *Chloroflexus aggregans* |
| C2-25 | 61 | *Demequina aurantiaca* |
| C2-26 | 62 | *Thalassospira* sp. TSL5-1 |
| C2-27 | 63 | SAMN04487830_13920 [*Pseudobutyrivibrio* sp. OR37] |
| C2-28 | 64 | SAMN02910398_00008 [*Butyrivibrio* sp. YAB3001] |
| C2-29 | 65 | *Blautia* sp. *Marseille*-P2398 |
| C2-30 | 66 | *Leptotrichia* sp. *Marseille*-P3007 |

TABLE 2-continued amino acid sequences of C2c2 orthologoues

| Code | SEQ ID NO | Bacterial strain |
|---|---|---|
| C2-31 | 67 | Bacteroides ihuae |
| C2-32 | 68 | SAMN05216357_1045 [Porphyromonadaceae bacterium KH3CP3RA] |
| C2-33 | 69 | Listeria riparia |
| C2-34 | 70 | Insolitispirillum peregrinum |

In certain embodiments, the Cas13b protein according to the invention is or is derived from one of the orthologues as described in the table below, or is a chimeric protein of two or more of the orthologues as described in the table below, or is a mutant or variant of one of the orthologues as described in the table below (or a chimeric mutant or variant), including dead Cas13b, split Cas13b, destabilized Cas13b, etc. as defined herein elsewhere, with or without fusion with a heterologous/functional domain. The amino acid sequence of wild type orthologues is provided in Table 3 below

TABLE 3

Cas13b Orthologues

| Name or Accession No. | SEQ ID NO: |
|---|---|
| WP_015345620 | 71 |
| ( | |
| WP_049354263 | 72 |
| WP_061710138 | 73 |
| Alistipes sp. ZOR0009 | 74 |
| 6 | |
| SIS70481.1 | 75 |
| Prevotella sp. P5-125 | 76 |
| 15 | |
| WP_042518169 | 77 |
| WP_044072147 | 78 |
| WP_044074780 | 79 |
| 8_(modified) | 180 |
| Riemerella anatipestifer | |
| WP_064970887 | 81 |
| 5 | 82 |
| ERJ81700 | 83 |
| WP_036931485 | 84 |
| 85 | |
| Porphyromonas gingivalis | |
| 19 | |
| WP_012458414 | 86 |
| WP_013816155 | 87 |
| WP_039417390 | 88 |
| WP_039419792 | 89 |
| WP_039426176 | 90 |
| WP_039437199 | 91 |
| WP_061156470 | 92 |
| Prevotella intermedia | 93 |
| 12 | |
| Prevotella aurantiaca | 94 |
| 9 | |
| EGQ18444 | 95 |
| K1186756 | 96 |
| WP_006044833 | 97 |
| Prevotella intermedia | 98 |
| 2 | |
| Prevotella buccae | 99 |
| 3 | |
| EFU31981 | 100 |
| WP_004343581 | 101 |
| WP_007412163 | 102 |
| WP_044218239 | 103 |
| Prevotella intermedia | 104 |
| 21 | |
| BAU18623 | 105 |
| WP_036884929 | 106 |

TABLE 3-continued

Cas13b Orthologues

| Name or Accession No. | SEQ ID NO: |
|---|---|
| WP_073124441.1 | 107 |
| AFJ07523 | 108 |
| 4 | 109 |
| ERJ65637 | 110 |
| ERJ81987 | 111 |
| ERJ87335 | 112 |
| WP_005873511 | 113 |
| WP_021663197 | 114 |
| WP_021665475 | 115 |
| WP_021677657 | 116 |
| WP_021680012 | 117 |
| WP_023846767 | 118 |
| WP_039445055 | 119 |
| WP_061156637 | 120 |
| WP_021584635 | 121 |
| WP_015024765 | 122 |
| WP_047431796 | 123 |
| WP_072319476.1 | 124 |
| Flavobacterium branchiophilum | 125 |
| 16 | |
| EKY00089 | 126 |
| Prevotella saccharolytica | 127 |
| 10 | |
| WP_013446107 | 128 |
| WP_045968377 | 129 |
| SHM52812.1 | 130 |
| EHO08761 | 131 |
| EKB06014 | 132 |
| WP_006261414 | 133 |
| WP_006265509 | 134 |
| 11 | |
| 17 | 136 |
| OFX18020.1 | 137 |
| SDI27289.1 | 138 |
| WP_039442171 | 139 |
| 14 | 140 |
| 20 | 141 |
| EOA10535 | 142 |
| WP_005874195 | 143 |
| WP_039418912 | 144 |
| WP_039431778 | 145 |
| ( | |
| WP_046201018 | 146 |
| WP_052912312 | 147 |
| WP_058019250 | 148 |
| WP_014165541 | 149 |
| Porphyromonas gulae | 150 |
| 13 | |
| WP_060381855 | 151 |
| WP_063744070 | 152 |
| 18 | 153 |
| WP_041989581 | 154 |
| Bergeyella zoohelcum | 155 |
| 1 | |
| EKB54193 | 156 |
| Prevotella sp. MA2016 | 157 |
| 7_(modified) | |
| Prevotella sp. MA2016 | 158 |
| 7_(modified)_-_residues only | |

In certain example embodiments, the Cas13 protein is a Cas13c protein. Wild type sequences of example Cas13c orthologues are provided below in Table 4.

TABLE 4

Cas13c Orthologues

| Name | Sequence |
|---|---|
| EHO19081 | 159 |
| WP_0948 | 160 |
| 99336 | |
| WP_0404 | 161 |

TABLE 4-continued

Cas13c Orthologues

| Name | Sequence |
|---|---|
| 90876 WP_047396607 | 162 |
| WP_035935671 | 163 |
| WP_035906563 | 164 |
| WP_042678931 | 165 |
| WP_062627846 | 166 |
| WP_005959231 | 167 |
| WP_027128616 | 168 |
| WP_062624740 | 169 |
| WP_096402050 | 170 |

Various modifications and variations of the invention will be apparent to those skilled in the art without departing from the scope of the invention. Although the invention has been described in connection with specific preferred embodiments, it should be understood that the invention as claimed should not be unduly limited to such specific embodiments. Indeed, various modifications of the described modes for carrying out the invention which are obvious to those skilled in the relevant fields are intended to be covered by the present invention.

The following examples are merely illustrative of the present invention and should not be construed to limit the scope of the invention as indicated by the appended claims in any way.

EXAMPLES

Example 1: Production of a Plasmid Vector for Expressing a C2c2 Variant and gRNAs The C2c2 sequences of Lw (from *Leptotrichia wadei*) and LbFSL (from Listeriaceae bacterium FSL M6-0635) (see Table 2 above) were provided in a plasmid with EF1alpha promoters driving the NES-tagged C2c2 with mCherry fused to the C-terminus. The C2c2 coding region were obtained therefrom (removing the NES and mCherry sequences and adding in a STOP codon).

These C2c2 coding regions were PCR amplified and ligated into plant expression vectors comprising a rice actin promoter or dicot 35S promoter.

Additionally, vectors encoding the gRNAs shown in Table 3 below were generated. The vector comprised a rice U6 promoter or the *Arabidopsis* U6 promoter. The vectors were designed from provided sequences by annealing oligos encoding the desired gRNA sequence.

The vectors can be constructed analogously as in Zahir Ali, et al., Genome Biology, 2015, 16:238.

For transformation, these vectors were combined via golden gate cloning and put into *Agrobacterium* vectors (based off pCAMBIA) for whole plant transformation or basic expression vectors for protoplasts (see example 2). The following vectors were constructed Monocot C2c2:
 pOsActin-Lsh-C2c2-HSP
 pOsActin-Lw2-C2c2-HSP
 pOsActin-Lbm-C2c2-HSP
 pOsActin-LbNK179-C2c2-HSP
 pOsActin-Ca-C2c2-HSP
 pOsActin-LbFSL-C2c2-HSP Dicot C2c2:
 pCaMV35S-Lsh-C2c2-HSP
 pCaMV35S-Lw2-C2c2-HSP
 pCaMV35S-Lbm-C2c2-HSP
 pCaMV35S-LbNK179-C2c2-HSP
 pCaMV35S-Ca-C2c2-HSP
 pCaMV35S-LbFSL-C2c2-HSP Monocot gRNA:
 pOsU6-Lsh-gRNA-ccdB
 pOsU6-Lw2-gRNA-ccdB
 pOsU6-Lbm-gRNA-ccdB
 pOsU6-LbNK179-gRNA-ccdB
 pOsU6-Ca-gRNA-ccdB
 pOsU6-LbFSL-gRNA-ccdB Dicot gRNA:
 pAtU6-Lsh-gRNA-ccdB
 pAtU6-Lw2-gRNA-ccdB
 pAtU6-Lbm-gRNA-ccdB
 pAtU6-LbNK179-gRNA-ccdB
 pAtU6-Ca-gRNA-ccdB
 pAtU6-LbFSL-gRNA-ccdB Each monocot/dicot C2c2 vector was used with the corresponding monocot/dicot gRNA construct Exemplary plasmid maps are provided in FIG. 2.

Example 2: Down-Regulation of Target RNA in Plant Cells

Rice protoplasts were prepared (Chen, S., L. Tao, L. Zeng, M. E. Vega-Sanchez, K. Umemura, and G. L. Wang. 2006. A highly efficient transient protoplast system for analyzing defence gene expression and protein-protein interactions in rice. Mol. Plant Pathol. 7:417-427. doi:10.1111/j.1364-3703.2006.00346.x., incorporated by reference) and co-transfected with 15 µg of DNA expressing each C2c2 variant along with 15 µg of DNA encoding the guide RNA cassette. Four different guide RNAs were tested, two targeting actin and two targeting polyubiquitin, both highly expressed genes. Forty eight hours after transfection, the protoplasts were lysed with Trizol (Life Technologies) according to the manufacturer's instructions for total RNA isolation. Ten nanograms of total RNA was used for each real time quantitative PCR reaction using the SuperScript III Platinum SYBR Green One-Step qRT-PCR Kit (Life Technologies). Primers specific for actin, polyubiquitin, and Ef1α (internal control) were used to amplify the cDNA generated in this reaction on a LightCycler 480 PCR machine (Roche). Relative expression levels of actin and polyubiquitin were analyzed with Ef1α serving as an internal control. Primers for actin and Ef1α were previously reported (Jain, M., A. Nijhawan, A. K. Tyagi, and J. P. Khurana. 2006. Validation of housekeeping genes as internal control for studying gene expression in rice by quantitative real-time PCR. Biochem. Biophys. Res. Commun. 345:646-651. doi:10.1016/j.bbrc.2006.04.140, incorporated by reference).

The following gRNAs and PCR primers were used:

TABLE 3 gRNAs and PCR Primers gRNAs

| | |
|---|---|
| Actin 1 | GAAAATGATAACAGATAGGCCGGTTGAA (SEQ ID NO: 17) |
| Actin 2 | TATCATCCCAGTTGCTGACGATACCATG (SEQ ID NO: 18) |
| Polyubiquitin 1 | TCTTGGCCTTCACGTTGTCGATGGTGTC (SEQ ID NO: 19) |
| Polyubiquitin 2 | GGACTCAACCTCCAAGGTGATCGTCTTG (SEQ ID NO: 20) |

PCR Primers

| | |
|---|---|
| Actin Forward | CAGCCACACTGTCCCCATCTA (SEQ ID NO: 21) |
| Actin Reverse | AGCAAGGTCGAGACGAAGGA (SEQ ID NO: 22) |
| Polyubiquitin Forward | GTCTCTGAGCGTGTGCTGT (SEQ ID NO: 23) |
| Polyubiquitin Reverse | GATATGACAGACGAGCGGCA (SEQ ID NO: 24) |
| Eflα Forward | TTTCACTCTTGGTGTGAAGCAGAT (SEQ ID NO: 25) |
| Eflα Reverse | GACTTCCTTCACGATTTCATCGTAA (SEQ ID NO: 26) |

The relative expression data obtained in the plant cells are shown in FIG. 1

The results show the following: The two C2c2 variants tested here are Lw (from *Leptotrichia wadei*) and LbFSL (from Listeriaceae bacterium FSL M6-0635). These graphs represent untransfected protoplasts (Untransfected), protoplasts transfected with the C2c2 alone (Lw and LbFSL), or the protoplasts transfected with the indicated C2c2 as well as the indicated gRNA. All expression data is from triplicate PCR reactions shown relative to EF1α expression measured in the same set of protoplasts.

The data indicate that of the two tested C2c2s, the LbFSL C2c2 works well at knocking down the expression level of both actin and polyubiquitin.

Example 3: Down-Regulation of Target RNA in Plant Cells Using Further C2c2 Orthologs Preparation and transfection of rice protoplasts was performed as described in Example 2 using the constructs for the different C2c2s as described in Example 1. The guide RNAs used targeted EPSPS and HTC, respectively. RNA isolation and quantification were carried out as described in Example 2. Relative expression levels of EPSPS and HTC were analyzed with Efl α serving as an internal control.

Figure 3:
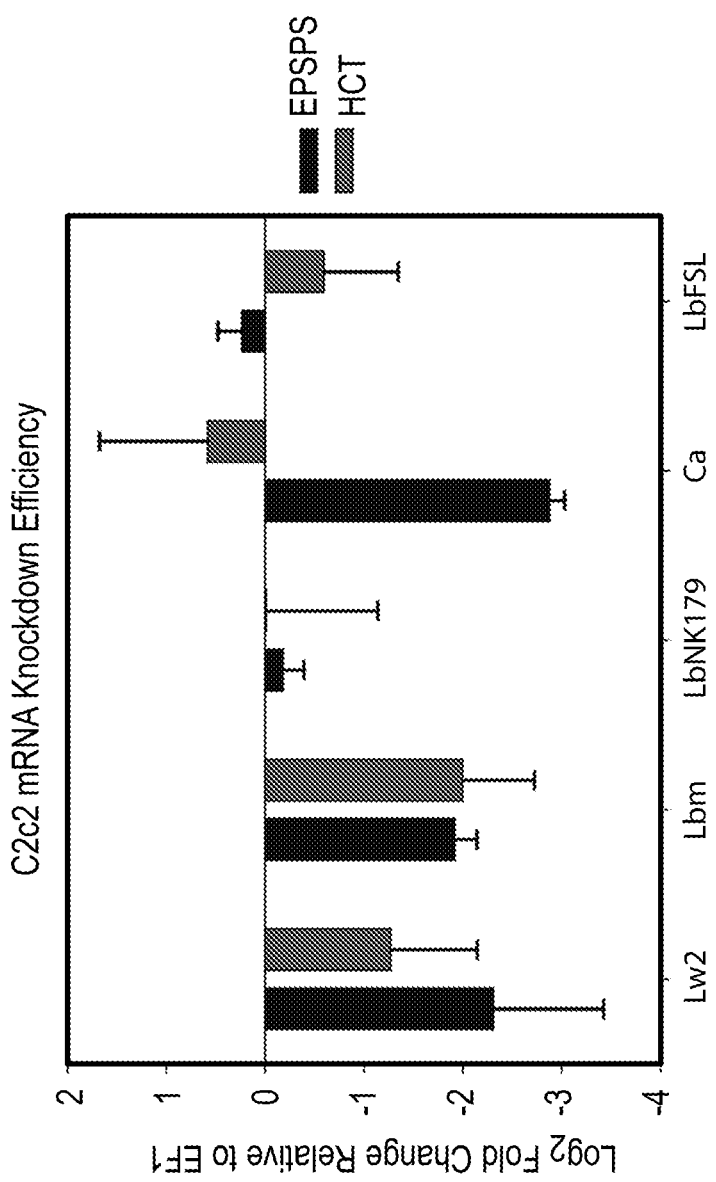
FIG. 3 shows C2c2 mediated knockdown in plant cells using further C2c2 orthologs (Lw2, LbM, LbNK179 and Ca) as well as LbFSL and targeting further mRNAs (5-enolpyruvylshikimate-3-phosphate (EPSP) synthase (EPSPS) and Hydroxycinnamoyl-CoA:shikimate hydroxycinnamoyl transferase (HCT).

The following gRNAs and PCR primers were used:
The relative expression data obtained in the plant cells from 3 independent experiments are shown in FIG. 3.

The results show the following: The C2c2 variants tested here are Lw2 (L *wadei* F0279) and Lbm (from Lachnospiraceae bacterium MA2020), LbNK179 (from Lachnospiraceae bacterium NK4A179), Ca (from [*Clostridium*] *aminophilum* DSM 10710) and LbFSL (from Listeriaceae bacterium FSL M6-0635). The results shown in FIG. 3 demonstrate that the two target transcripts EPSPS and HTC could be knocked-down using the tested C2c2s (Lw2, Lbm, LbNK179, Ca and LbFSL). Unexpectedly, from all effector proteins tested the two C2c2 effector proteins Lw2 (*L. wadei* F0279) and Lbm (from Lachnospiraceae bacterium MA2020) provided the most effective knock-down results.

Example 4

Figure 4:
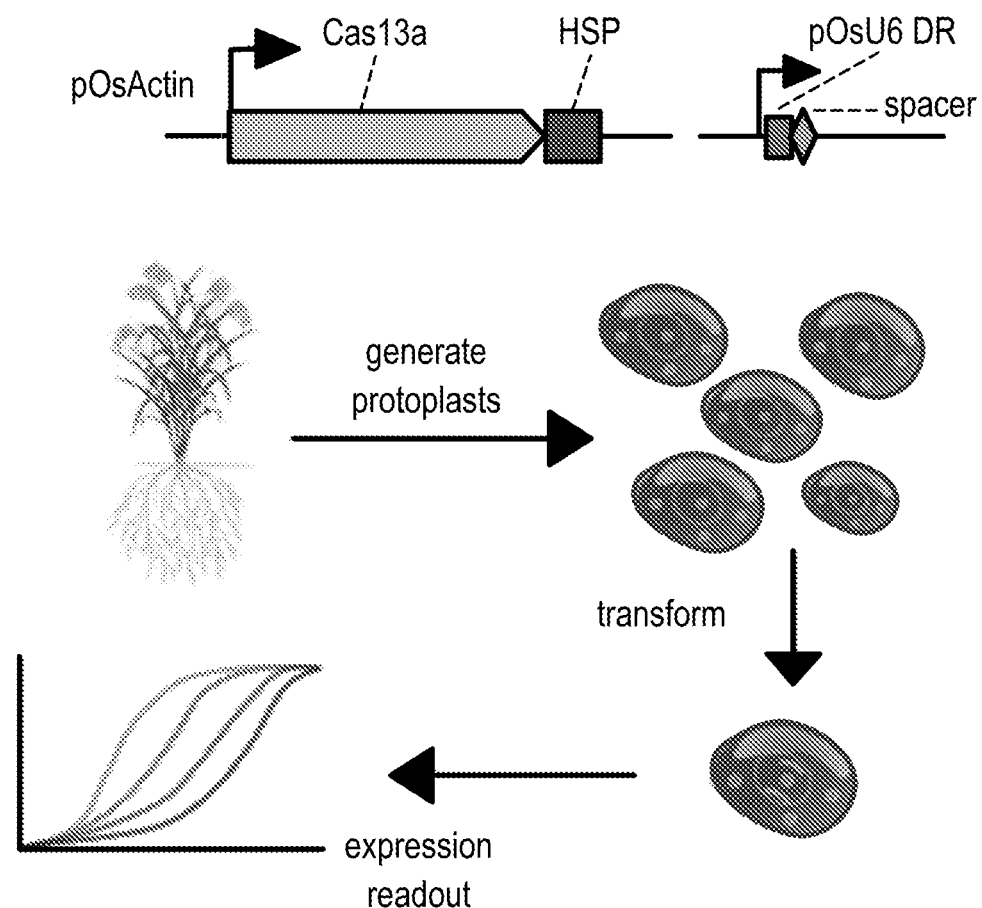
FIG. 4 provides a schematic for LwaCas13a knockdown of transcripts in rice (*Oryza sativa*) protoplasts.
Figure 5:
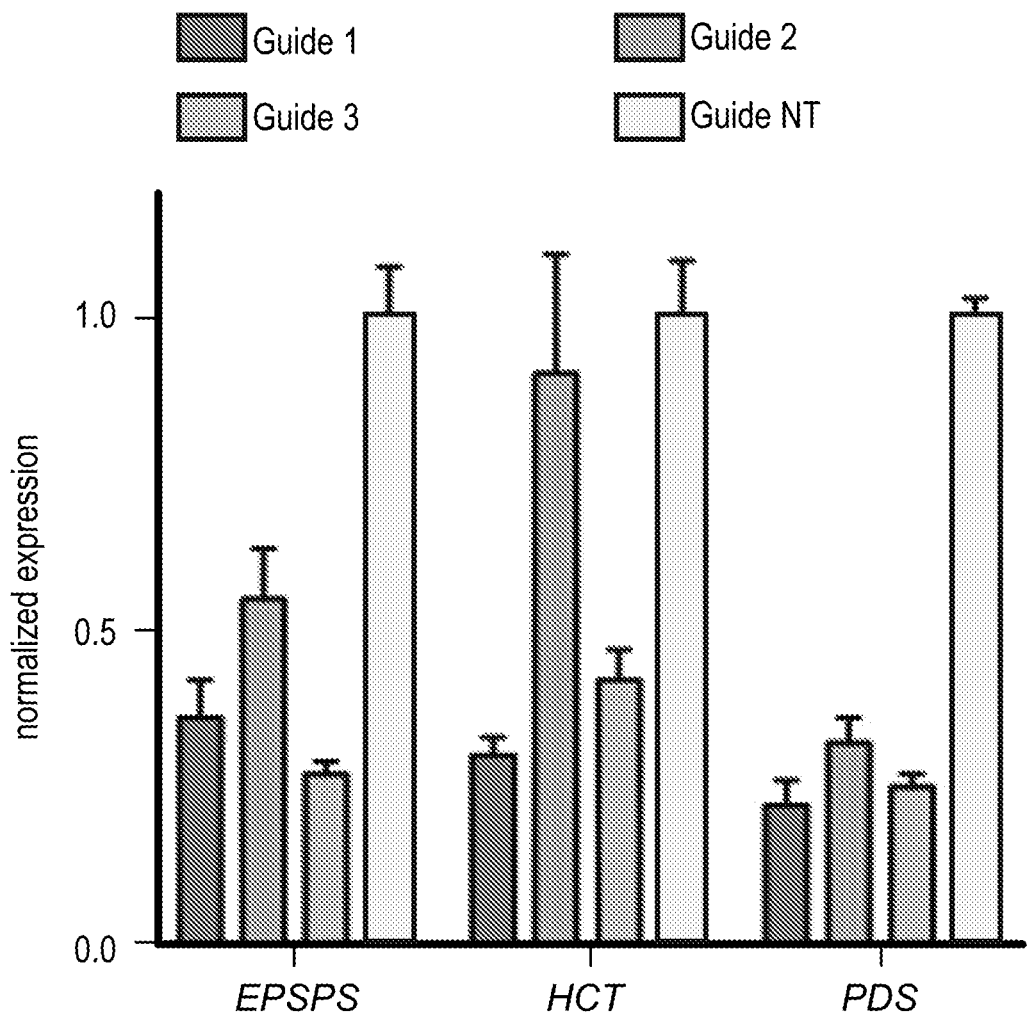
FIG. 5 shows LwaCas13 knockdown of three transcripts in *O. sativa* protoplasts using three targeting guides per transcript (n=6). All values are mean f SEM with n=3, unless otherwise noted.

To test if LwaCas13a knockdown is efficient in plants, three rice (*Oryza sativa*) genes were targeted with three guides per transcript and co-transfected LwaCas13a and guide vectors into *O. sativa* protoplasts. See FIG. 4. After transfection, >50% knockdown with seven out of the nine guides and maximal knockdown of 78% (FIG. 5) was observed.

For the plant knockdown experiments, the rice actin promoter (pOsActin) was PCR amplified from pANIC6A and LwaCas13a was PCR amplified from human expression LwasCas13a constructs. These fragments were ligated into existing plant expression plasmids such that each LwaCas13a was driven by the rice actin promoter and transcription was terminated by the HSP terminator, while the LwaCas13a gRNAs were expressed from the rice U6 promoter (pOsU6).

The guides used in this study are listed in Table 5.

TABLE 5

Guide RNAs

| | | | |
|---|---|---|---|
| EPSPS guide 1 (SEQ. ID. No. 171) | CCACCACCACCGCC TCCCGCCGCCCCCG | C | FIG. 5 |
| EPSPS guide 2 (SEQ. ID. No. 172) | TGCTCCCATCATCT CAAGTACCTCAGCA | A | FIG. 5 |
| EPSPS guide 3 (SEQ. ID. No. 173) | CCCTTGACACGAAC AGGTGGGCATTCAG | A | FIG. 5 |
| HCT guide 1 (SEQ. ID. No. 174) | AGAAGGTCACCTGT ACGGCGAGCACGGC | T | FIG. 5 |
| HCT guide 2 (SEQ. ID. No. 175) | CAGATCCGCTTGAG GGTGGCGATCTGGT | C | FIG. 5 |
| HCT guide 3 (SEQ. ID. No. 176) | CCGGACGATCGGGC ATCCCCGCCATCTC | A | FIG. 5 |
| PDS guide 1 (SEQ. ID. No. 177) | GACTGAGCACAAAG CTTCCCAGATAGAA | T | FIG. 5 |
| PDS guide 2 (SEQ. ID. No. 178) | ACCATCCAAGAATG CCATCTTAGAACCA | A | FIG. 5 |
| PDS guide 3 (SEQ. ID. No. 179) | CCTGGCAAACAACC TGTAGAGCACCGAG | A | FIG. 5 |
| Non-targeting guide for green rice protoplast experiment (SEQ. ID. No. 180) | TAGATTGCTGTTTC ACACAGATATGCAT | N/A | FIG. 5 |

Green rice protoplasts (*Oryza sativa* IL. ssp *japonica* var. Nipponbare) were prepared as previously described (Zhang et al. Plant Methods 7, 30, (2011)) with slight modifications. Seedlings were grown for 14 days and protoplasts were re-suspended in MMG buffer containing 0.1 M CaCl$_2$. This modified MMG buffer was used to prepare fresh 40% PEG buffer as well as in place of WI buffer. Finally, protoplasts were kept in total darkness for 48 hours post-transformation. All other conditions were previously described.

For the green rice experiments, plasmids expressing each LwaCas13a and corresponding guide RNA were mixed in equimolar ratios such that the total of 30 μg of DNA was used to transform a total of 200,000 protoplasts per transformation.

Total RNA was isolated after 48 hours of incubation using Trizol according to the manufacturers' protocol. One nanogram of total RNA was used in the SuperScript II Plantinum SYBR Green One-step qPRT-PCR Kit (Invitrogen) according to the manufacturer's protocol. All samples were run in technical triplicate of three biological replicates in a 384-well format on a LightCycler 480 Instrument (Roche). All PCR primers were verified as being specific based on melting curve analysis and are as follows: OsEPSPS (Os06g04280), 5'-TTG CCA TGA CCC TTG CCG TTG TTG-3' (SEQ. ID. No. 181) and 5'-TGA TGA TGC AGT AGT CAG GAC CTT-3' (SEQ. ID. No. 182); OsHCT (Os1 1g07960), 5'-CAA GTT TGT GTA CCC GAG GAT TTG-3' (SEQ. ID. No. 183) and 5'-AGC TAG TCC CAA TAA ATA TGC GCT-3' (SEQ. ID. No. 184); OsEF1a (Os03g08020), 5'-CTG TAG TCG TTG GCT GTG GT-3' (SEQ. ID. No. 185) and 5'-CAG CGT TCC CCA AGA AGA GT-3' (SEQ. ID. No. 186). Primers for OsEF1a were previously described (Jain et al. Nat Protoc. 12, 828-863 (2017)).

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (186 sequences)

SEQ ID NO: 1 - protein, 1434 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTLKRPAATKKAGQAKKKKGSYPYDVPDYAYPYDVPDYAYPYDVPDYA

SEQ ID NO: 2 - protein, 1197 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 3 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 4 - protein, 1340 aa, Lachnobacterium species
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 5 - protein, 1437 aa, Lachnobacterium species
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 6 - protein, 1385 aa, Closstridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 7 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 8 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 9 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 10 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 11 - protein, 1051 aa, Listeria newyorkensis
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 12 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 13 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 14 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 15 - protein, 1285 aa, Rhodobacter capsulatus; identical to SEQ ID NO: 14

SEQ ID NO: 16 - protein, 11 aa, Artificial Sequence
  Synthetic
LYPERLRRILT

SEQ ID NO: 17 - DNA, 28 bp, Artificial Sequence
  Synthetic
gaaaatgataacagataggccggttgaa

SEQ ID NO: 18 - DNA, 28 bp, Artificial Sequence
  Synthetic
tatcatcccagttgctgacgataccatg

SEQ ID NO: 19 - DNA, 28 bp, Artificial Sequence
  Synthetic
tcttggccttcacgttgtcgatggtgtc

SEQ ID NO: 20 - DNA, 28 bp, Artificial Sequence
  Synthetic
ggactcaacctccaaggtgatcgtcttg

SEQ ID NO: 21 - DNA, 21 bp, Artificial Sequence
  Synthetic
cagccacactgtccccatcta

SEQ ID NO: 22 - DNA, 20 bp, Artificial Sequence
  Synthetic
agcaaggtcgagacgaagga

SEQ ID NO: 23 - DNA, 19 bp, Artificial Sequence
  Synthetic
gtctctgagcgtgtgctgt

SEQ ID NO: 24 - DNA, 20 bp, Artificial Sequence
  Synthetic
gatatgacagacgagcggca

SEQ ID NO: 25 - DNA, 24 bp, Artificial Sequence
  Synthetic
tttcactcttggtgtgaagcagat

SEQ ID NO: 26 - DNA, 25 bp, Artificial Sequence
  Synthetic
gacttccttcacgatttcatcgtaa

SEQ ID NO: 27 - protein, 7 aa, Simian virus 40
PKKKRKV

SEQ ID NO: 28 - protein, 16 aa, Artificial Sequence
  Synthetic
KRPAATKKAGQAKKKK

SEQ ID NO: 29 - protein, 9 aa, Artificial Sequence
  Synthetic
PAAKRVKLD

SEQ ID NO: 30 - protein, 11 aa, Artificial Sequence
  Synthetic
RQRRNELKRSP

SEQ ID NO: 31 - protein, 38 aa, Artificial Sequence
  Sythetic
NQSSNFGPMKGGNFGGRSSGPYGGGGQYFAKPRNQGGY

SEQ ID NO: 32 - protein, 42 aa, Artificial Sequence
  Synthetic
RMRIZFKNKGKDTAELRRRRVEVSVELRKAKKDEQILKRRNV

SEQ ID NO: 33 - protein, 8 aa, Polyomavirus
VSRKRPRP

SEQ ID NO: 34 - protein, 8 aa, Polyomavirus
PPKKARED

SEQ ID NO: 35 - protein, 8 aa, Homo sapiens
PQPKKKPL

SEQ ID NO: 36 - protein, 12 aa, Mus sp.
SALIKKKKKMAP

SEQ ID NO: 37 - protein, 5 aa, Influenza virus
DRLRR

SEQ ID NO: 38 - protein, 7 aa, Influenza virus
PKQKKRK

SEQ ID NO: 39 - protein, 10 aa, Hepatitus virus
RKLKKKIKKL

SEQ ID NO: 40 - protein, 10 aa, Mus sp.
REKKKFLKRR

SEQ ID NO: 41 - protein, 20 aa, Homo sapiens
KRKGDEVDGVDEVAKKKSKK

SEQ ID NO: 42 - protein, 17 aa, Homo sapiens
RKCLQAGMNLEARKTKK

SEQ ID NO: 43 - DNA, 33 bp, Artificial Sequence
  Synthetic
ctgtaccctgagcggctgcggcggatcctgacc

SEQ ID NO: 44 - DNA, 15 bp, Artificial Sequence
  Synthetic
ggggsggggsggggs

SEQ ID NO: 45 - DNA, 20 bp, Artificial Sequence
  Synthetic
gagtccgagcagaagaagaa

SEQ ID NO: 46 - DNA, 20 bp, Artificial Sequence
  Synthetic
gagtcctagcaggagaagaa

SEQ ID NO: 47 - DNA, 20 bp, Artificial Sequence
  Synthetic
gagtctaagcagaagaagaa

SEQ ID NO: 48 - protein, 12 aa, Artificial Sequence
  Synthetic
FWYHKMILVAGC

SEQ ID NO: 49 - protein, 12 aa, Artificial Sequence
  Synthetic
WYHKREDCSTNQ

SEQ ID NO: 50 - protein, 4 aa, Artificial Sequence
  Synthetic
FWYH

SEQ ID NO: 51 - protein, 5 aa, Artificial Sequence
  Synthetic
HKRED

SEQ ID NO: 52 - protein, 9 aa, Artificial Sequence
  Synthetic
VCAGSPTND

SEQ ID NO: 53 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 54 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 55 - protein, 1344 aa, Eubacteriu rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 56 - protein, 1373 aa, Eubacterium species
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 57 - protein, 1276 aa, Blautia sp.
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 58 - protein, 1385 aa, Leptotrichia sp.
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 59 - protein, 1334 aa, Lachnobacterium species
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 60 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 61 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 62 - protein, 1235 aa, Thalassospira sp.
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 63 - protein, 1312 aa, Pseudobutyrivibrio sp.
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 64 - protein, 1343 aa, Butyrivibrio sp.
MKISKVDHRKTAVKITDNKGAEGFIYQDPTRDSSTMEQIISNRARSSKVLFNIFGDTKKSKDLNKYTESLIIYVNKAIKSLKGDKRNNKYEEITESLKTERVLNALIQAGNEFTCSENNIEDALNKYLKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 65 - protein, 1276 aa, Blautia sp.; identical to SEQ ID NO: 57

SEQ ID NO: 66 - protein, 1168 aa, Leptotrichia sp.
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 67 - protein, 1138 aa, Bacterioides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 68 - protein, 697 aa, Porphyromonadaceae bacterium
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 69 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 70 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 71 - protein, 948 aa, Artificial Sequence
  Riemerella anatispestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 72 - protein, 948 aa, Artificial Sequence
  Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 73 - protein, 950 aa, Artificial Sequence
  Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 74 - protein, 953 aa, Artificial Sequence
  Alistipes sp.
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 75 - protein, 1036 aa, Artificial Sequence
  Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 76 - protein, 1090 aa, Artificial Sequence
  Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 77 - protein, 1090 aa, Artificial Sequence
  Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 78 - protein, 1090 aa, Artificial Sequence
  Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 79 - protein, 1090 aa, Artificial Sequence
  Prevotella sp.
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 80 - protein, 1095 aa, Artificial Sequence
  Riemerella anatispestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 81 - protein, 1095 aa, Artificial Sequence
  Riemerella anatispestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 82 - protein, 1115 aa, Artificial Sequence
  Synthetic
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 83 - protein, 1115 aa, Artificial Sequence
  Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 84 - protein, 1116 aa, Artificial Sequence
  Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 85 - protein, 1119 aa, Artificial Sequence
  Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 86 - protein, 1119 aa, Artificial Sequence
  Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 87 - protein, 1119 aa, Artificial Sequence
  Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 88 - protein, 1119 aa, Artificial Sequence
  Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 89 - protein, 1119 aa, Artificial Sequence
  Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 90 - protein, 1119 aa, Artificial Sequence
  Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 91 - protein, 1119 aa, Artificial Sequence
  Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 92 - protein, 1119 aa, Artificial Sequence
  Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 93 - protein, 1120 aa, Artificial Sequence
  Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 94 - protein, 1124 aa, Artificial Sequence
  Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 95 - protein, 1125 aa, Artificial Sequence
  Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 96 - protein, 1125 aa, Artificial Sequence
  Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 97 - protein, 1125 aa, Artificial Sequence; identical to SEQ ID NO: 95
  Prevotella pallens

SEQ ID NO: 98 - protein, 1126 aa, Artificial Sequence
  Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 99 - protein, 1127 aa, Artificial Sequence
  Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 100 - protein, 1127 aa, Artificial Sequence; identical to SEQ ID NO: 99
  Prevotella buccae

SEQ ID NO: 101 - protein, 1127 aa, Artificial Sequence
  Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 102 - protein, 1127 aa, Artificial Sequence
  Prevotella sp.
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 103 - protein, 1131 aa, Artificial Sequence
  Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 104 - protein, 1132 aa, Artificial Sequence
  Prevotella intremedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 105 - protein, 1133 aa, Artificial Sequence
  Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 106 - protein, 1133 aa, Artificial Sequence
  Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 107 - protein, 1133 aa, Artificial Sequence
  Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 108 - protein, 1134 aa, Artificial Sequence
  Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 109 - protein, 1135 aa, Artificial Sequence
  Synthetic
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 110 - protein, 1135 aa, Artificial Sequence
  Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 111 - protein, 1135 aa, Artificial Sequence
  Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 112 - protein, 1135 aa, Artificial Sequence
  Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 113 - protein, 1135 aa, Artificial Sequence
  Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 114 - protein, 1135 aa, Artificial Sequence; identical to SEQ ID NO: 110
  Porphyromonas gingivalis

SEQ ID NO: 115 - protein, 1135 aa, Artificial Sequence
  Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 116 - protein, 1135 aa, Artificial Sequence; identical to SEQ ID NO: 111
  Porphyromonas gingivalis

SEQ ID NO: 117 - protein, 1135 aa, Artificial Sequence; identical to SEQ ID NO: 112
  Porphyromonas gingivalis

SEQ ID NO: 118 - protein, 1135 aa, Artificial Sequence
  Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 119 - protein, 1135 aa, Artificial Sequence
  Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 120 - protein, 1135 aa, Artificial Sequence
  Porphyromonas gulae
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 121 - protein, 1139 aa, Artificial Sequence
  Prevotalla pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 122 - protein, 1145 aa, Artificial Sequence
  Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 123 - protein, 1145 aa, Artificial Sequence
  Chryseobacterium sp,
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 124 - protein, 1149 aa, Artificial Sequence
  Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 125 - protein, 1150 aa, Artificial Sequence
  Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 126 - protein, 1150 aa, Artificial Sequence
  Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 127 - protein, 1151 aa, Artificial Sequence
  Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 128 - protein, 1154 aa, Artificial Sequence
  Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 129 - protein, 1155 aa, Artificial Sequence
  Flavobacterium sp.
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 130 - protein, 1156 aa, Artificial Sequence
  Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 131 - protein, 1157 aa, Artificial Sequence
  Myoides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 132 - protein, 1157 aa, Artificial Sequence
  Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 133 - protein, 1157 aa, Artificial Sequence; identical to SEQ ID NO: 131
  Myroides odoratimimus

SEQ ID NO: 134 - protein, 1157 aa, Artificial Sequence; identical to SEQ ID NO: 132
  Myroides odoratimimus

SEQ ID NO: 135 - protein, 1159 aa, Artificial Sequence
  Synthetic
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 136 - protein, 1159 aa, Artificial Sequence
  Synthetic
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 137 - protein, 1161 aa, Artificial Sequence
  Bacterioides bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 138 - protein, 1165 aa, Artificial Sequence
  Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 139 - protein, 1174 aa, Artificial Sequence
  Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 140 - protein, 1175 aa, Artificial Sequence
  Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 141 - protein, 1175 aa, Artificial Sequence
  Synthetic
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 142 - protein, 1175 aa, Artificial Sequence
  Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 143 - protein, 1175 aa, Artificial Sequence
  Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 144 - protein, 1175 aa, Artificial Sequence
  Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 145 - protein, 1175 aa, Artificial Sequence
  Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 146 - protein, 1175 aa, Artificial Sequence
  Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 147 - protein, 1175 aa, Artificial Sequence
  Porphyromonas gulae
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 148 - protein, 1175 aa, Artificial Sequence
  Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 149 - protein, 1179 aa, Artificial Sequence
  Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 150 - protein, 1199 aa, Artificial Sequence
  Porphyromonas gulae
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 151 - protein, 1213 aa, Artificial Sequence
  Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 152 - protein, 1213 aa, Artificial Sequence
  Flavobactrium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 153 - protein, 1214 aa, Artificial Sequence
  Synthetic
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 154 - protein, 1218 aa, Artificial Sequence
  Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 155 - protein, 1224 aa, Artificial Sequence
  Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 156 - protein, 1224 aa, Artificial Sequence; identical to SEQ ID NO: 155
  Bergeyella zoohelcum

SEQ ID NO: 157 - protein, 1322 aa, Artificial Sequence
  Prevotella sp.
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 158 - protein, 1322 aa, Artificial Sequence; identical to SEQ ID NO: 157
  Prevotella sp.

SEQ ID NO: 159 - protein, 668 aa, Artificial Sequence
  Fusobacterium necrophorum
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 160 - protein, 796 aa, Artificial Sequence
  Tissierella sp.
MEKDKKGEKIDISQEMIEEDLRKILILFSRLRHSMVHYDYEFYQALYSGKDFVISDKNNLENRMISQLLDLNIFKELSKVKLIKDKAISNYLDKNTTIHVLGQDIKAIRLLDIYRDICGSKNGFNKFINTMITISGEEDREYKEKVIEHFNKKMENLSTYLEKLEKQDNAKRNNKRVYNLLKQKLIEQQKLKEWFGGPYVYDIHSSKRYKELYIERKKLVDRHSKLFEEGLDEKNKKELTKINDELSKLNSEMKEMTKLNSKYRLQYKLQLAFGFILEEFDLNIDTFINNFDKDKDLIISNFMKKRDIYLNRVLDRGDNRLKNIIKEYKFRDTEDIFCNDRDNNLVKLYILMYILLPVEIRGDFLGFVKKNYYDMKHVDFIDKKDKEDKDTFFHDLRLFEKNIRKLEITDYSLSSGFLSKEHKVDIEKKINDFINRNGAMKLPEDITIEEFNKSLILPIMKNYQINFKLLNDIEISALFKIAKDRSITFKQAIDEIKNEDIKKNSKKNDKNNHKDKNINFTQLMKRALHEKIPYKAGMYQIRNNISHIDMEQLYIDPLNSYMNSNKNNITISEQIEKIIDVCVTGGVTGKELNNNIINDYYMKKEKLVFNLKLRKQNDIVSIESQEKNKREEFVFKKYGLDYKDGEINIIEVIQKVNSLQEELRNIKETSKEKLKNKETLFRDISLINGTIRKNINFKIKEMVLDIVRMDEIRHINIHIYYKGENYTRSNIIKFKYAIDGENKKYYLKQHEINDINLELKDKFVTLICNMDKHPNKNKQTINLESNYIQNVKFIIP

SEQ ID NO: 161 - protein, 897 aa, Artificial Sequence
  Fusobacterium ulcerans
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 162 - protein, 919 aa, Artificial Sequence
  Cetobacterium sp.
MEEIKHKKNKSSIIRVIVSNYDMTGIKEIKVLYQKQGGVDTFNLKTIINLESGNLEIISCKPKEREKYRYEFNCKTEINTISITKKDKVLKKEIRKYSLELYFKNEKKDTVVAKVTDLLKAPDKIEGERNHLRKLSSSTERKLLSKTLCKNYSEISKTPIEEIDSIKIYKIKRFLNYRSNFLIYFALINDFLCAGVKEDDINEVWLIQDKEHTAFLENRIEKITDYIFDKLSKDIENKKNQFEKRIKKYKTSLEELKTETLEKNKTFYIDSIKTKITNLENKITELSLYNSKESLKEDLIKIISIFTNLRHSLMHYDYKSFENLFENIENEELKNLLDLNLFKSIRMSDEFKTKNRTNYLDGTESFTIVKKHQNLKKLYTYYNNLCDKKNGFNTFINSFFVTDGIENTDFKNLIILHFEKEMEEYKKSIEYYKIKISNEKNKSKKEKLKEKIDLLQSELINMREHKNLLKQIYFFDIHNSIKYKELYSERKNLIEQYNLQINGVKDVTAINHINTKLLSLKNKMDKITKQNSLYRLKYKLKIAYSFLMIEFDGDVSKFKNNFDPTNLEKRVEYLDKKEEYLNYTAPKNKFNFAKLEEELQKIQSTSEMGADYLNVSPENNLFKFYILTYIMLPVEFKGDFLGFVKNHYYNIKNVDFMDESLLDENEVDSNKLNEKIENLKDSSFFNKIRLFEKNIKKYEIVKYSVSTQENMKEYFKQLNLDIPYLDYKSTDEIGIFNKNMILPIFKYYQNVFKLCNDIEIHALLALANKKQQNLEYAIYCCSKKNSLNYNELLKTFNRKTYQNLSFIRNKIAHLNYKELFSDLFNNELDLNTKVRCLIEFSQNNKFDQIDLGMNFINDYYMKKTRFIFNQRRLRDLNVPSKEKIIDGKRKQQNDSNNELLKKYGLSRTNIKDIFNKAWY

SEQ ID NO: 163 - protein, 1110 aa, Artificial Sequence
  Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 164 - protein, 1111 aa, Artificial Sequence
  Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 165 - protein, 1111 aa, Artificial Sequence
  Anaerosalibactr massiliensis
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 166 - protein, 1111 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSVTERKLIEEKVAENYSLLANCPMEEVDSIKIYKIKRFLTYRSNMLLYFASINSFLCEGIKGKENETEEIWHLKDNDVRKEKVKENFKNKLIQSTENYNSSLKNQIEEKEKLLRKESKKGAFYRTIIKKLQQERIKELSEKSLTEDCEKIIKLYSKLRHSLMHYDYQYFENLFENKETPELKDKLDLHLFKSLPLIRKMKLNNKVNYLEDGDTLFVLQKTKKAKTLYQIYDALCEQKNGFNKFINDFFVSDGEENTVFKQIINEKFQSEMEFLGKRISESEEKNPKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKMAFGFLFCEFDGNISRFKDEFDASNQEKIIQYHKNGEKYLTYFLKEEEKEKFNLKKLQETIQKTGKENWLLPQNKNNLFKFYLLTYLLLPYELKGDFLGFVKKHYYDIKNVDFMDENQSSKIIESKEDDFYHKIRLFEKNTKKYEIVKYSIVPDEKLKQYFKDLGIDTKYLILEQKSEVSGEKNKKVSLKNNGMFNKTILLFVFKYYQIAFKLFNDIELYSLFFLREKSGKPFEVFLKELKDKMIGKQLNFGQLLYVIYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLGKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLMIEKNTLKISSNGKIISLVPHYSYSIDVKY

SEQ ID NO: 167 - protein, 1115 aa, Artificial Sequence
  Fusobacterium necrophorum
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 168 - protein, 1121 aa, Artificial Sequence
  Fusobacterium perfoetns
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 169 - protein, 1137 aa, Artificial Sequence
  Prevotella sp.
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 170 - protein, 1158 aa, Fusobacterium varium
MENKNKPNRGSIVRIIISNYDMKGIKELKVRYRKQAQLDTFILQTTLDKSNNSILINDFRVKAREKYRYSFTYDGKEKFSVPSNSIIVTKIDNAAPEKSKEIRKYKITLGIDEKCKTGSMITAAIEDLLEDDRVREGIRNPRRKASKTERKLITESICHNYAQITQCPVEEIDAVKIYKVKRFLSYRSNMLLFFALINDFLCKNLKNEKGEKINEIWEMENKGNNKKIDFDENYNILVAQIKEYFTKEIENYNNRIDNIIDKKELLKYSEEKEESEKNKKLEELNKLESQKLKILTDEEIKADVIKIIKIFSDLRHSLMHYEYKYFENLFENKKNEELAELLNLNLFKNLTLLRQMKIENKTNYLEGDEKFNILGKDVRAKNALGHYDLLVEQKNGFNNFINSFFVQDGTENLEFKKFIDENFIKAQKELEEDIKNCKESVKKLEKKLKENPKKSEDLEKKLEKKQKKLKELKKELEKMKQHYKRLNCAYVWDIHSSTVYKKLYNERKNLIEKYNKQLNGLQDKNAITGINAQLLRIKKEMEEITKSNSLFRLKYKMQIAYAFLEMEYEGNIAKFKNEFDCSKTEKIQEWLEKSEEYLNYCMEKEEDGKNYKFHFKEISEIKDTHNEEWLENTSENNLFKFYILTYLLLPMEFKGDFLGVVKKHYYDIKNVDFTDESEKELSQEQIDKMIGDSFFHKIRLFEKNTKRYEIIKYSILTSDEIKKYFELLELKVPYLEYKGIDEIGIFNKNIILPIFKYYQIIFRLYNDLEIHGLFNVSFDINKILSDLKSYGNENINFREFLYVIKQNNNSSTEEEYQKIWEKLESKYLKEPLLTPEKKEINKKTEKELKKLDGISFLRNKISHLEYEKIIEGVLKTAVNGENKKTSETNADKVFLNEKIKKIINFIKENELDKIELGFNFINDFFMKKEQFMFGQIKQVKEGNSDSITTERKRKEENNKRLKITYGLNYNNLSKIYEFSNTLREIVNSPLFLKDSTLLKKVDLSKVMLKEKPICSLQYENNTKLEDDIKRILLKDSSDIMGIYKAEVVKKLKEKLVLIFKYDEEKKIYVTVYDTSKAVPENISKEILVKRNNSKEEYFFEDNKKKYTTQYYTLEITKENELKVIPAKKLEGKEFKTEKKEENKLMLNNHYCFNVKIIY

SEQ ID NO: 171 - DNA, 28 bp, Artificial Sequence
  Synthetic
ccaccaccaccgcctcccgccgcccccg

SEQ ID NO: 172 - DNA, 28 bp, Artificial Sequence
  Synthetic
tgctcccatcatctcaagtacctcagca

SEQ ID NO: 173 - DNA, 28 bp, Artificial Sequence
  Synthetic
cccttgacacgaacaggtgggcattcag

SEQ ID NO: 174 - DNA, 28 bp, Artificial Sequence
  Synthetic
agaaggtcacctgtacggcgagcacggc

SEQ ID NO: 175 - DNA, 28 bp, Artificial Sequence
  Synthetic
cagatccgcttgagggtggcgatctggt

SEQ ID NO: 176 - DNA, 28 bp, Artificial Sequence
  Synthetic
ccggacgatcgggcatccccgccatctc

SEQ ID NO: 177 - DNA, 28 bp, Artificial Sequence
  Synthetic
gactgagcacaaagcttcccagatagaa

SEQ ID NO: 178 - DNA, 28 bp, Artificial Sequence
  Synthetic
accatccaagaatgccatcttagaacca

SEQ ID NO: 179 - DNA, 28 bp, Artificial Sequence
  Synthetic
cctggcaaacaacctgtagagcaccgag

SEQ ID NO: 180 - DNA, 28 bp, Artificial Sequence
  Synthetic
tagattgctgtttcacacagatatgcat

SEQ ID NO: 181 - DNA, 24 bp, Artificial Sequence
  Synthetic primer
ttgccatgacccttgccgttgttg

SEQ ID NO: 182 - DNA, 24 bp, Artificial Sequence
  Synthetic Primer
tgatgatgcagtagtcaggacctt

SEQ ID NO: 183 - DNA, 24 bp, Artificial Sequence
  Synthetic Primer
caagtttgtgtacccgaggatttg

SEQ ID NO: 184 - DNA, 24 bp, Artificial Sequence
  Synthetic Primer
agctagtcccaataaatatgcgct

SEQ ID NO: 185 - DNA, 20 bp, Artificial Sequence
  Synthetic Primer
ctgtagtcgttggctgtggt

SEQ ID NO: 186 - DNA, 20 bp, Artificial Sequence
  Synthetic Primer
cagcgttccccaagaagagt

What is claimed:

1. A plant modified to express
(a) a Type VI Clustered Regularly Interspersed Short Palindromic Repeat (CRISPR) effector protein, and
(b) one or more guide RNAs (gRNAs), comprising a first and a second guide RNA, each having complementarity with a target ribonucleotide sequence of one or more plant virus RNA molecules, and each capable of forming a complex with the Type VI CRISPR effector protein and hybridizing to the target ribonucleotide sequence in said plant,
wherein the ribonucleotide sequence of the first guide RNAs does not comprise a ribonucleotide sequence of a first plant virus chosen from Tobacco mosaic virus (TMV), Tomato spotted wilt virus (TSWV), Cucumber mosaic virus (CMV), Potato virus Y (PVY), Cauliflower mosaic virus (CaMV) (RT virus), Plum pox virus (PPV), Brome mosaic virus (BMV) and Potato virus X (PVX),
wherein the ribonucleotide sequence of the second guide RNA comprises a ribonucleotide sequence of a second plant virus chosen from *Citrus tristeza* virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), *Arabis* mosaic virus (ArMV), and *Rupestris* stem pitting-associated virus (RSPaV),
wherein the polynucleotide encoding the Type VI CRISPR effector protein or gRNA, or both, is stably integrated into the plant's genome,
wherein the Type VI CRISPR effector protein is chosen from *Leptotrichia wadei* F0279, Lachnospiraceae bacterium MA2020, or Listeriaceae bacterium FSL M6-0635, and
wherein the first and second plant viruses are different.

2. The plant of claim 1, wherein the one or more guide RNAs further comprise a third guide RNA, and wherein the ribonucleotide sequence of the third guide RNA comprises a ribonucleotide sequence of a third plant virus.

3. The plant of claim 1, wherein the one or more guide RNAs (gRNAs) in a complex with the Type VI CRISPR can hybridize to the target ribonucleotide sequence of a plant virus RNA molecule which triggers:
(i) cleavage of the target ribonucleotide sequence,
(ii) an increase in translation of the target RNA molecule,
(iii) a reduction in translation of the target RNA molecule, or
(iv) a change in splicing of the target RNA molecule.

4. The plant of claim 1, wherein the target ribonucleotide sequence of the one or more guide RNAs comprises one or more target ribonucleotide sequences of:
(i) an mRNA molecule of a pathogen susceptibility gene;
(ii) an mRNA of a herbicide resistance gene; or
(iii) an mRNA of an enzyme required for lignin or volatile organic compound (VOC) biosynthesis.

5. The plant of claim 1, wherein said Type VI CRISPR effector protein cleaves the target ribonucleotide sequence of the first and second plant viruses if the viruses infect or have infected said plant.

6. The plant of claim 1, wherein said Type VI CRISPR effector protein is expressed in said plant from an inducible promoter.

7. The plant of claim 1, wherein the one or more guide RNAs are not expressed from a DNA sequence in said plant.

8. The plant of claim 4, wherein the pathogen susceptibility gene is chosen from translation initiation like factors elF4E and elF(iso)4E, Mildew-resistance locus (MLO) proteins, ERF transcription factor gene OSERF922, alcohol dehydrogenase and polyphenol oxidase (PPO).

9. The plant of claim 1, wherein the plant is selected from the group consisting of *Oryza sativa, Solanum tuberosum, Solanum lycopersicum, Zea mays, Triticum* spp., *Triticum aestivum, Sorghum bicolor, Dioscorea* spp., *Musa* spp., *Manihot esculenta, Glycine max, Gossypium hirsutum, Hordeum vulgare, Avena sativa, Secale cereale, Brassica rapa* and *Brassica napus*.

10. The plant of claim 1, wherein said plant is a cereal plant, a pseudocereal plant, or a vegetable plant.

11. The plant of claim 4, wherein the enzyme required for lignin biosynthesis is chosen from 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl COA 3-O-methyltransferase (CCOAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyl-transferase, and aldehyde dehydrogenase (ALDH), and the enzyme required for herbicide resistance is chosen from Resistance to *Phytophora infestans* (RPi) genes, 5-enolpyruvylshikimate-3-phosphate synthase, acetolactate synthase (ALS) and 15-cis-phytoene desaturase chloroplastic/chromoplastic, and wherein the gene required for volatile organic compound (VOC) biosynthesis is chosen from patchoulol synthase, linalool/nerolidol synthase and E-(b) caryophyllene synthase.

12. A plant part of the plant of claim 1, wherein the plant part comprises the Type VI CRISPR effector protein and a nucleotide sequence encoding the Type VI CRISPR effector protein.

13. The plant part of claim 12, wherein said plant part is chosen from the group consisting of a plant cell, a somatic embryo, a pollen, gametophyte, ovule, a leaveleaf, a seedling, a stem, a callus, a stolon, a microtuber, a shoot, a seed, a fruit and a spore.

14. A composition comprising at least two plant parts of claim 13.

15. A packaging comprising the plant of claim 1.

16. The plant of claim 4, wherein the pathogen is chosen from Tobacco mosaic virus (TMV), Tomato spotted wilt virus (TSWV), Cucumber mosaic virus (CMV), Potato virus Y (PVY), the RT virus Cauliflower mosaic virus (CaMV), Plum pox virus (PPV), Brome mosaic virus (BMV), Potato virus X (PVX), *Citrus tristeza* virus (CTV), Barley yellow dwarf virus (BYDV), Potato leafroll virus (PLRV), Tomato bushy stunt virus (TBSV), rice tungro spherical virus (RTSV), rice yellow mottle virus (RYMV), rice hoja blanca virus (RHBV), maize rayado fino virus (MRFV), maize dwarf mosaic virus (MDMV), sugarcane mosaic virus (SCMV), Sweet potato feathery mottle virus (SPFMV), sweet potato sunken vein closterovirus (SPSVV), Grapevine fanleaf virus (GFLV), Grapevine virus A (GVA), Grapevine virus B (GVB), Grapevine fleck virus (GFkV), Grapevine leafroll-associated virus-1, -2, and -3, (GLRaV-1, -2, and -3), *Arabis* mosaic virus (ArMV), or *Rupestris* stem pitting-associated virus (RSPaV).

17. The plant of claim 4, wherein the one or more guide RNAs are capable of binding to a same or different target RNA molecule.

18. The plant of claim 10, wherein said plant is a rice plant.

19. The plant of claim 18, wherein said rice plant is *Oryza sativa*.

* * * * *